United States Patent 12,576,115 (BACTERIAL COMPOSITIONS FOR TREATING AND PREVENTING HALITOSIS) - sequence listing, part 29

SEQ ID NO: 47 - DNA, 4575038 bp, unidentified (residues 3,050,027-4,575,038 of 4,575,038)
  source 1..4575038: mol_type = genomic DNA; note = Lentilactobacillus buchneri
aattagtaatgacagttgccgctgtggtttctaagtctttatcaaattgagtcacaccagatttaaaggttggaacgacaccatcttcatacttattaatcattgccactgtccggtttaataggttaccgagatcgttagctaaatcataattaattttgtcgacaaagtcttccggtgtgaacaccccatcatttccataaggcatagctttcaataaatagtaacgaagtgcatctaggccgtaacgttcaaccaaagtttctggataaataacgttccccttagatttggacattttaccgtctttcatcaataaccagccatggccgacaacgtgttttggtaattgtaaaccaagggcatgcaacatgattggccaataaattgtgtggaaacgcacaatctctttaccgaccatatgcacgtcagcaggccaatacttatcaaagttactttgatcatcgctgccataacccagtgcggtaatatagtttgataacgcatcaatccaaacataaaccacatgtttagggttgtttttaacttttacaccccagttgaaagttgttcgcgaaacagctaaatcttccaaaccgggtttgataaagttattaatcatctcattcatccgtgttgcaggctgaataaagtcaggatgatctttgtagtattgcaataaccaatctgcatacttactcattttgaagaaataagattcttctttaactttttgaacttcatgaccagatggcgcttttccaccgatcactttaccactttcatcacgataaacttctgccaattgcgtttcagtgaagtactcttcatccgaaaccgaataccagccttcatattcacctaaataaatatcgtcactatcttccaatttttggaagatttcttgaacggccttttcgtggtagtcatcagttgtccgaataaatttggtgttagaaatatccaaaagtttccacagctttttaatcccttcagccatcccatccacgtatgctttgggagttgtgtttagggcttcagctttttgttcaatttttaaaccatgttcgtcagttcccgttaagaagaaaacatctttgccttctaatcgttgaaaacgggcctcagcatcacaagcaattgttgtgtacgaattcccgatatgaagctttcctgacggataataaattggtgtcgttatataatatgtgggtttgtctgccattgaagatttccttcctagttctaataattttatattttaaattaataatttaaagtagaatgttttaactttaagtatatcacaaagaatcgccgcgcaaagcgtgtttcacacgtttgatggcggacaattgaattttatttatgtcattaaaagagacctagttgcaatggccccaatccatcaaaattaattcctaatatttcctttaatcttaaagcattgccagctgcatctttaccgctgttattgttaaaaatgatacatacctcttcagcttgcggttctaattttttgacaagtttcgcaaaactttgtagttcttcctctgaatacttgtagagtgtccgctttccgcgccagttaggccctttttcaacccagccttttgcattttgaccatgtaatcgtaaaacggccaaattctgatttgtcaccgtatctaccaaaggcacgccattagggactgagctgggttcatcaaccgaaacatgactcatgcctagtttcttcaaataaagcattgtttcatcacgaaccgccggatcataccagctagaattacgaaactctacggcaattggcaagtcacccatcaaaacccgcacgtcacgcaggtaacgaatattgtctaattggcagttaaaatagggtggaaattgaaataggatcgtttttagttgatcgctcttaactaaaggacgaatcattttccgaaattcggtaaaaactaaacggtgttcatctgacaaatagtcattaacatcagctccatcatgcaaggtcatcagtttgttagcctttaaaataaattgaaacccctctggaacagatttttgccaattttcaacggtcgatacttttggcacaccgtaaaaagaagtatccacctcaactaccggaaaatagccggcatattctgttaattcaacttttcgatcctcatgatcaatgagagccggatggtctgtccatgttgttaatccaatcgtaatcaattctctttgcctcagtctatcgatattttaagcctagtctatcacagtttctatacgcaatcagtagttaaatattcctgtagcgttttatttagattcccgtatactaaaatagttgcctcttaattcaaagcaactggttgaaagcgagaatttttgtttaaaacttttcttggttcacttctggtagtaattttaaatttcttatgtggctactggttgaatacacatgactgaaagtaatttttccacccacttgtattaattttgccttgctgaatttaatacgcaattataggtgtaaaaaaggccttaactactggaaatagttaaggtctttggtatgtcattttgttgacgcccttctcgcacattcatttattacgtgtacttttaaagctagcaaaaattagaatagactactaatatatttttttatagcgaaacgtgttgaagagagcagcttcctccgcttgccagttcttgcggtctgaacctcggccacaagaatggtcaacgtccggaacataattggttattagtgtttgtggctaataaccattcctgcgtgtggagtagtgccagttcttgcggtctgaacctcggccacaagaatggtcatcgcccggaacatataggattattagcgttctttgctaataatcatcctctatgtggagtagtgccagttcttgcggtctgaacttcggccacaagaatggtcatcgcccggaacataataggttattagcgtttttggctaataaccattcctgcgtgtggagtagtagctacgatagtcaaacgattcctaactcgaatcattggggttcgaagaccgtttcatgctttattgccgaaacgtgtttaaaaaggcagcttcttccgcttagctacgaaagggcaacgattcctaacccgaatcattgccctttctatgcgttttaattttttatagccgaaacgttgttaaagagagcagtttcctccgcatgccagttcttgcggtctgaacctcggccacaagaatggtcaacgtccggaacataattggttattagcgtttttgggctaataaccatccctgcgtgtggagtagtagctacgatagtcaaacgattcctaacccgaatcattcgactatctatgctaatgctcataaactaccgctctctttaacactcttttttatacaaactgaatcaaactcatcacaatcggcacaaccactataaacaaaattgtacttgtcgttaccaagtttgtcgcaaacttcacatcaccatgcgactcgttcgccaatattggcattaccgccaaacctggtgccgccgcctgcacaatcaacgtctgcatttccatcgttggaattgcatgccccatacttgctccccacataatcaacatcgtgatcacaattggtgacaacacaaatcgacccaacaacgcaaaaatcgtatctttatcaaaattaatactcttcaaaccggcatccgccaacacaatcccgatataaatcaaggacaatggtgtgaccaaattacctacataacttaaagtattatttgcccaatctggtactggcaaactcaaaatcaaccaaactaacgcaaccaaaaagcctaacaatggtggtggcaagagtttcttccagttaaagttaccagaacctttttcacccttcttcttcgttggatcatcgtttgaaatcaagaacacaccaaatgcccaagtcgaaacggtattagtaacataataaaccaagaaatatggcaaactaactgatccaaacaacgcaatgtttaaaggtagcccaataaaaatggtatttgcattcacaacggtattcataaaaattccacgccgtcctggacgcacacgcaaaacctttacggccaaccaagcgatgatgtagccaataatgaccccaccaaatgaataaattaagccactcgaaagactaattaatttattcaaagttaggtacttcattacagatacaaagattgaagctggtaaagccacattcataatcaattttgagatgctgccactaaagttatcatcaaaccagccaattcggcggagtaaataacctagggccatcattagtaaaattgtcacaatactttcaacagaagttataaaagccatgataatccttcctctacttaaatccttttatttttaatattttaatacttaggttcccacttcacatcgttaatagcctgatcaacatctgaaataggttcttgattcaatttttgatctacagcactttgggcaacggcctttgcgactgtaaatgagaattgatcaagttttgaaacaggaggtaaaacagctgctcctggtttgttaccatccacaataccacccaatgaatgagcagcttgtgagatcatttcatcatttaatacctttgcagttgaagcaatgacacctaaacctaatccaggataaactaacgcattattagcctgaccaatttggtaagtgacaccattgtaatcaacatctgcagctggaattccagttgcaaccaaagccttaccatcactccatttgatcaaatcttcagcctttgcttctgcaagcttcgttggatttgataatgggaagataattggacgctcagtatgagcagccatctctttcacaacagcttccgtaaaggttcctggttgagttgatgttcccaccaaaatggttgggtgaatggctttaacagcagcttcaagcgtcgttagttcatcagcattggcaaattctgaacgtgaacgtgcaaatggtttttgttctggtgtcaaagtttgatcatcatcaaacagcaaaccttgtttgtccaccatatagaagtgtttcttagcctcttctgcagataaaccttgttgcaagaactcgtcgtaaattcgtttcgtaataccagcaccggcagttcctgctccgtatgacaagtacacttggtctgtcatcttttgttttgaaatattcaaagcaccaagaatcccagctaacacaatgattcctgttccctgaatatcatcattaaatgtggtgatttggtccttatacttattcaagatattagcagcattatcacgaccaaaatcttcaaaatgcaagtacaacttagggaataagtcttcagcagtattaacaaactgatcaacaaatttgtaataacgatcgccagtaacacgttcgtgacggttgccaagatacatagggttcttcaacaagccttgattgttagtacctacatcaagcacaacaggcatgacttggcttggatcgataccagcagcagcggtataaaccatgagtttaccaaccgagatatcaaccccgtttgtgccccagtcaccaattcccaagattccttcagcatcagttaccacgatcaaacgaatgtcgcgaccatcagcagcatttttcaatgaggctttcatgctgtcaggatcatcgattgacaagaaaacggcattttgtgattgaataaataaatcactgtaattttcgattgtgtcggcgatcgttggatcatacacgattggcataaactcgacaacgtgttggctaaacaatttgtaaaacaaaacacgattctcgttgaagatttccattaagaaaatccgtttttctaaatcactagtttttgtttgtaattgggcataagtttgtttagcttgatcatccaaggtttggacataaggtggtaataaaccaaccaaaccaagtgattgacgctctttttcagtaaacgcggtacctttattttcaaaaggattatttaaaatttctacaggactttttgtcatattcataacctccagttacttactttttgttctcaacgaaaggtcactatacacgcctgaaaaaactatagtcaaatctttaagaatgtattaaaaaatctaataagctttatggaaagcctaataatatcacggctgaccattagtaaagttttttagtacttttagataggatttaatagtccaaaaagttataataaaaatagtaaagaaatagaccggaaaaagcagaggaggaataattatgagtaaaaaactgacaaaatcatcagataagatgattgcaggggtagttggtggctttgcagaatatatgggaatagataagacattggcacgagtactttacgcggcaatttcaatcccaggatttttcccatgtattattttgtacattgtggcggcatgggtgatgccggaaaaaaattagtgagcggattgagacgggtttacttttactaaataagggcactggatgcggggagaattccccgctggaagtgtgcttatttagtaaaagtgtgtctcaaggagctgtcctaatttagtgagcggatgaaaacgtccatgactatactcataagtgtgccgtcagcaggatgaagtccggcgctaggcatgcttatgagtatagtcatgttttcaggagctgtcctaaaaattagtgagcggaacaaaccgggagtctttaatctataagtgagatggaggtgggatcgcaatctcgcagaaatcttgcttatggattaaagactggtttgaggagcttaattcaggacccgcccaatcccaaaaatacatcacgaggcaaatacatgaacatcaaagattttgaatattttcaagcaatgattgaagaacgtaatttttcacgggtggccgccaaatttaaagtgagtcagccaactattagtacggccattaaacgtcttgaaacagaatttcagacacaactgtttgtccgtgatgccagccagcataagttgacaacgaccttaagcggccagcaactggccgagcacaccaccattgttttggatcaggtaaacatcgctcaaagcgaaattcgtaatatcaatactggaaaagtcgtgcttggattaccgccagtaattagccagtcctattttcctcaaattgcggcggaattggttaagcacgatctcctttcacaaatcgtacctattgaacacggttcggcagaattattaaaacttttacttaacggcacgcttgatatggctcttgtgggttccatccaaccatttgattcggcacgcctttttagccaaactttcgcacaaactaagtttcacattgttgttagtaaaaaaagccctcttgcggccaaaaagggaattttgtttcgtgatttaaaaaacgagaacttcattacctttgggaggagcttcgttcattcagaagccctcaaccaattaagtcatgccaatcactttcgaccaaagattatttacgaaagtaatgatccacaagtgattcaaggtatgattgctaaaaatgttgggttgagctttttggctgaatcggccattacaaatcccgatgtggttcaactaaaactgttagatgatccccaacctgaattttatatgagtttggcctatcgcactaatcatattctgtcgccgattcagaaaaaagtcgtcgacatttgtttaaaaatggaaaataaagcagctggaaaaaattaactttccagctgctttattattaagcgaatctatttttaatatctttcaaactgtctaatgaccataacttcatcttctgacaattgcccaccaaggtgaccaattaacgtacgcccaactttacgataattttttcgaatttgtgtaaaacataaatcaatgattgcaattaaaaacgtgacaatcatagcactgttctgtgttaacacggccccaaataaattaactgtatcgccactcaaaactgttcttaaaaatgcaaaaatcataattaaatcaagcaccacttgaaggcgcatgagaccacgcatgcgtttttttaatttaacaagttgctgaaagatatcctgacgcttcatggttcagatcctcctgactacaaaccgatgctaacatccattatctatcctttattttaagctaaatataactcttggtaaactatttgatttccaccaaaaattatcggaccgaataggctagatttagctgtttaaaaagtgtttccacagacatgctgtatagagtcttgaaataatcatccgtttttcctttgggtggatccggcaaaacaaacgcattttgttgatcgttaaccccaattccaatataggctcgctctttagtctctgcacttttaatttcagaatgagaaatttgaaacaactgccgtacttccaaccgcaattggcgtttactgaacacactacctaacgtcacaaactctttgctaccaactgttggcaactgccatttttcaagttgagcgtcaaatgcttcaaaggcttttacaacagttcttcgcaaggtaaacggtgaatcaaccggtttggcagaaataatttggtatacattttgcgcacctgccagagaaatggggtaatcgcgtttgaattgatccgctactttatcaaagtcattcccgaaaaagacgagtgcatccaaaatcgttaacaaacgcaaatgcatcatcccatccatttcaccattttcttctggcttaatggtttgttggaccccttttaaatactgtttttgaacctcgtcattcaataaaccgtgctgtttttgccattcataaattgtcaaatgagtaatggtatcatataaagtcgtggtaacgatcatcagttgttcgtcaaaatcacgatgtccacttgtcacgttgaaagaaatcgttgggtagccagtcgcatctaataaagcatgctgcaattcatgagaaacggtgtaattcggcgcagtaacatccttcacatgaatgatcaaatcgccattttgccaactttggtaggattggtcataacgcacatatccggatttttccgtgccataatcgaacaccacatcaccagaaatcttctgattcacttcattcagtagttcgtttacttcattattaagttgaatatcactcattactttctcctcgtagttgttttaaaatttgccgtgcagtttgttcatcaattacaggtgccttttctaaaagtagctgggcttctgcgagttcagctgacgttgcgccattgcttagcaacaatgactttgcttgcaaatgcatgtgtcctcgttgaattccttctgaaaccaaagcttttaaggccgccaagttttgtgctaatccaacacttacaatgacttcttctaattcttttgccgtttttacctgcatcaaacgatgatttagttgggctttgcgattaatcttgattgaaccgccaacaaatcccactggtaaaggtaatgttaaagaacctaccaaaaatttatcttcaatttgccagcgactaagccctcgatattggccatctcgagcagcatatgcatgcgcactgctttcaatgcttcgccaatcattcccggaagccattacgacagcatcaacaccattcataattcctttgttatgcgttgtcgcacgatagggatcaacctgcgctgcctcactggccatgacaattcgattggcaatttcatctccgtcaaactgttttgttgctaaagcagtcattgaaattcggcaggtcgcagttgccaaacactcatcagacaaattactcaaaattgccattaaactagtttgcccaagttcaaggtgtaagaaattcgaaactccttctaacatcgcattaatcatattagcacccattgcttcctttgtaccaataaaaatatctaatgaaacaaactggtgatcaagctttcttacacgtattttttttgcgccacccccacgtttaacaatggatggatgtgcatcattagcagtctgtaaaattttattttcattttctcgcaaaagctgtgcaagtttttctgaatcatgaacatttgccattaaaacttggcccatcatcaatcgatccgttatcttggtctggatgccgccatcaatcgccattattttggcgccattgcttgctgctgcaatcacggatggctcttctgtcaccatcggaactactttttcttctccgttaatcacaaagttaactgcaacaccttcagaaatcggaaaatccatcaagtaattttcaataatctgatcaccttgagtggtattttcatctgcaattatagcctcgtcgtccgcagttaagtttaactgtttttttagaatcgtcagacgttgcgcataagtttgtttataaaattgctttaaattcattaatttaattctcctaaaaccaaaaaacgcggtgaaactcatttttacaatgtgcttttccgcttttgatatttttgtttggtttagcgatgctgaacatactcagaaatgatgccttcacggacaccactttccgagaagatcacccgatcagcatccaacatttggagtaacatcactaatggtaaaataccaccaataataatgtcagctcgttgtgtttctaaccctggcatctttttacgattaattaagtttcgggataacaaagctcgaaaagttttgttgaccacttctgtttttaaacgatagccatgaatattatctactcgtaatattccttgatgttggcgattcatacgtgccaaagttcgattagcgccacccagtaaaataattggtaattgaacagcatccataatccaccaaatatcgcgaaactgtttattcacaaaattttgagcagcaaataaccgatcagcgcggaccacattgtttaaatggaatcgttccgaaagactcacggcgccaaatggtacacttatcaagttgcgaggtttcccattttcaacatgaattaattcacaactagccccaccagtgtccagaatcaaacaatcccgaatttccagagaattcatgacacctaaatagtcataatatgcttcatcgttacccgacaaaacgtcaagttgaatgccaatctcatcttgaacccggtttaaaaattcggcttgattacgcgccacccgaaccgctgctgtcgtaattccacgtaccgtacgattcggatagctttcatagatatgcttaaaccgttttaaggctgccacggttcggtccatcgccacttgctgcagaatatgattgctgcccattccttcagagatgcgagagtcttccttaattcgccggacctcatgaaagcttccgtcctcgtgaatttcgttaattgccattcgaactgaattggaacctaaatccacaataactaagttttccattttgacacctctcaatccatcacgataatttaattgttcttattttaccatgttttcgtttaaacatgcgatgaacttgcgataaatgggtgtctgagaaaatgtaaacttactaaaattatggtttgagtttgataaagaaagatttcgcctagtttatatttttggacggctgcagaaaacatgactataaacataagcatgcccagcgccggacttcatcctgctgacggcacacttatgcttatagtcatggacgtttttatccgctcactaggttttaggacagcttctcaaaccagtctttaatccataagcaagattcctgcgggattgcgatcccgcatccatctcacttacggactaaagactcccggtttgttccgctcactaatttttaggacagcttctcgagacacacttttactaaataagcacactttcatcgggaaatcctccccgcatccagtgcccttatttagtaaaagcagacccgtctcaatccgctcactggttcttaggacagctcggcaaaacaggatagaaaatgtaaggcacgcctactgcggggatttttccgctttcggcgtgccttagccttacattttctatcctatcgttttgcctcgctcacttaaaataattaattcccatcgcatcccgcacttcatccaaagtttggtttgccaccttattcgccttttcactaccgcgcttcaaaatatcatacaccccaggaatatcctgtgcatactgctctcttcgctctcgaattggtttcaacgtattctgcaacacttcattcaaatatcgcttaattttaacgtctcccaatccccctgcttgatactgggccttcaaatctgccacttttttcttatccttatcaaaaatatccaaataagtgaaaactgtattgccttccacatggcccggatccgtcaccttaatatgctttggatctgtatacatcgacattactttcttttgaatcgtatcctcatcatccgacaaataaatcgcattattcaatgacttactcatctttgcattaccatctaagcccggaattcttcccaatccctttggtgggaaatatccctctggttcaaccaaaatctcttttccataaacattattaaacgttcgcacaatttcacgtgtctgttccagcattggctcctgatcatcgccaactggcaccgtatcagccttaaacgcagttatatctgcagcctgactcacaggataaatgaagaatcctgccggcacactttcgccaaactttttttgcttgatttctgttttgaccgttggatttctttccaaacgagaaacagtcaccaaattcaaataagtttccgtcaactcacttaatgcaggaatttgtgattgcactaaaattgtggatttttctggatcaatccccactgctaaatagtccaaagctacctgaattaaactattacgaattttttctggatcacgcgcattgtcggttaaagcctgcatatccgcaatcataatataactgtcataattaccagtattttgtaattcaactcgatttttaagtgaacccacataatgaccaatgtgtagctttcctgttgggcgatctccggttaaaattacgtgcttttttgtcataataaaatctcctcttctttgtgttttgtttcagtgcaaataaaaaatcccatcactagtaagactagtaataggacgaattcaccgtggtgccacctaatttgcagagtactctgccactcattgcagatatcggtgccccgtttaagcgttctccaaaacccaattcgtttttctgaaatctctcagcaaatgatttctctctggcggtgaaaaactactttatttcttcactgaacttgatatgttcattgtacctatctttagttttgggagcaagtcttgtttttataataaatattgattcttgtgccaaatcttcaccacaggaacttggcctcatcctcctgacagctcaacatcacccgattgacttcgcttgactttctcctccaaacagcctagaatatcgtaacactaaaatgcttttacactaagggagtcatgcaattgagcaccgttgattcaaatgaacttaaatccgaacaaacccgcgttgatcacgtcattcaaaaaattgaagcacaagccaatcacactcaaaaattggtcgatcaggcccactccgaaacgcgatctgttgaaagtaattactctcaaaacgcaaaaatcaatacctttgaagttgatgatcggatcgaaaccaatgccgaagttcaacaacaaaaaggcctggttgcacgtgccgttgaaaacgaaagtatccttaaacgacaagttgctacctacaagcagttacaggattcaccctattttggccgcatcgatattcaagatcctggtgaaactgacgtagaacccctatatatcggaaccgcttcgtttgctgatgaacacgaaaattttcttatttacgactggcgggcgccaatttcaagtatctactacaatggcactttaggaaatgtctcctaccaaactcctgccggtaaaatgaatactgatttggtgaaaaagcgccagttttctattcaatctggtaaaatcactaacatgtttgacaccaatgaaactgttgttgatgagattctgcaagaagtactcggacaacagaatgatacttacatggctaatattgtagccacgattcaaaaagaacaaaatgacatcattcgcgataccactagtgatttattggttgtccaaggtgtcgccggtagtggcaaaacttccgctatcttgcagcgaattgcttttttactttatcatagtcgtacttcgttaaatgcggatgaaattgtattgttctcacctaatcgcttgtatagtcgatatatttctgacgttttaccaagcttgggtgaacgaaacatgcgccaaatcacgctggctgattttctctctcaacgttttcagggattgaatgttgaaacggtttttgatcgatacgagcacaattcaaatattactggcgctgatgtagaattggctgaatttattgaaggaccagattttatgcgattggttgctaactatgtgaacaatttgtccccagataaaattcaatttaccaatgtcatgtttgaagaaaagccattctttaaagccactgatattcgaaaaatttatacagatttgccggacacaatgcgtccagccgatcgctttttaaaaactaaaaacacgttaattaaacaattaaaaaaacgacttgatgaagaagccaatgctgattggattcatgaaaccattgaccatttaagtaacgaagaatataacgacttaattggcaaaaagcgattacgtgcatttgaaagttatgacgatgaaattcattatttaggccgcaaactcgctgccaaacacttccaagttgtttatgatgctctctttaataattattttattgatgtttattcacaatatgtatcttttttaaaccaagtagaatttccaaaaacagtttcatcagcagcaaagcaaaaaaatcagtttgactttcaacaagctattgaatatcatcgcttacgcttaatggatgctgcaccactacttttaatgcgtgacttattcactggtagtggccgcaaccgtcaaattcagcatatttttattgatgagatgcaagattattcattagcacaaatgatgtactttaaacatgcgtttccaaacgcaaaatttacacttcttggtgatagtgaacaagctctctttaaaaacgttgaagcaccgcaaatcttgttaacccatttaaaagaagcttttaatgttaaaaaagctaatttaatcactttaaatcgaagttaccgctccacttatcccatcaccagttttgcaaaaaaacttttacctgacggggaccagattcaagccttcaatcgcgagggcagtttaccaagcgtcgtcattcgtgacacagttgcggatggtaatcaggccttaattgcaatttgtaaaaaagaactccaaacatacggaacagtagctattttgacgcgtaacatgacagaaagtcagcatgtttttgagaacattcatcgggctactaacgccaatctgctttcagatgcggatttagctttgcctaagggtgtcttgattatgcccatttatttggctaaggggctagaattcgactctgttattgcctacaatatttcacaaaataattaccccgaccaaagttctaccggaattttatacacgatggcttcgcgagcaatgcatagtctaaccttgttaagcattggtgctgcatccccgcttattaacgaagttgttaatgatcacgaacatttagttcaaattaaataattttttgtaaacaaaaagcgataaaatcaaaccaaaaccggtttgtcctatcgcttttattgagtctaaacttttctggtattggtgaataactaataccagttttttgtctattttaaaaatcagaaaaataaaaaggacacctgtcctctttgagttatgatttaatcaccaaaacaaatcgaaaagagaaaattcagatgtccctaattatttctatcttaagtttattcgaaataactgacctaatttcatttttgtttattaccatggatggtataagtgctaccactcaaattcccatgagcatctgttgcaaaatcagctgtttgaaccatcatttctgatgaagagttatcatctttatcactattacctgaagcacgctcagttgtctgacttgcttcgctttgcgcgttactaattgcacgtgaagtttcttggaactgtgtcacaggaatagctgcttgctgatattcgtcattcaaatcggccgcttcaaccgtggtagctgctgttgcccccgcaaacttagataagttttctaagtatggtgaacgatctactcgctgatgtgttgtcgtaacttgctgtaaggctgctgttgcgcgactaacctgttgaacaaccttagaaatagaagcggtgaccacacttgattcatcggtttttgaactacttgtctgaacggttgctgatgacgcagctttagcatccacacctacagaagctgaactagcagttgtagaggtcgatttacttgaagccgttgaaccagcagcgactgaactaatgctctcagaactagcttcagaaactgagcttgcttcactacttgtttggtcggtttttatatcagaggaagaaccttggtcagctgaacttgatgctgaagaagccacgctggtcgcctcagaactgtcagaagctgacacgctactagcaacactgctaaacgcagccacactagacgcactggaactgacagctactgcagaacttgcggcagctgctgaactgacgcttgcacttgagctacttacgctagatggcgtccaagtactaacagcagagctacttacaccacttgaaacgacggccgaacttgcagctactgagcttgacgaagccacagaactggttgctgaactcgttttggcacttgaacttgctgttgaactggcaacactacttgaacttactgaggaagtagcactacttacagctacagaacttgcactacttgctgtgctcgttgttgcactagccgcataagaactggaatatgcgtaactgcttgatttagttgttttaccagcctgcgtcgtgttattagtatctgctaatactggtgttgtttcattaaaagccacggcagcattgataccaactaaaacaagcccagcatatagccattgcttatgcactttgtacattttaaagtgcaatttttcgtctttctgatgaccaaaagtatgtttatcactattcttcatatataataacccccaaacttacagaatttaagattctctaaaagtaattatacgacattttttaagttttgaatacatcataaagtaaaatttatcacatttatttgttcaattgaataacctatttcgtggctaagtttcgttgatgcgtaatagcatgttttaaaataaacggcgcaataagtgtgaccaaaataattaccaaaatgacatctgaataatgcgtgggatcaatcaatttagccgcaaaccctatttgggccgtgattaagcccatttctcctcgtgaaatcattccggcaccgatgacgtaattactagacaaatcaaaccctgatattttgccaccaaggccacagccaaataattttgtcccgatacctaaaatggtcatcaacagcacaaagccaagagattgccataaatgggaaaaattcatatttaggcccacactcacgaagaacatggggataaaaatcgcatagccaattggctctacactttcgccaatttcttcgtgagcgggtgtcaatgccaccgcaatcccggcaaaaaacgcaccaactgcaccacttaaaccgactagttcagccaaccatgccatggataaacaaatgaccattgacatgattgtgcgacttgaagtcataaaaagacgatccgccgttcgcattaaatatggtgcaatccatttgataagtagataaacaccaacaaaatacaaaatttgttttaaaataaccagcaccaagttctgattgccgctggattcacccatcatgctaaccataatgcttagcaaaatcacaccaataatatcatccgcaactgcggctcctagaattgtggcgccttctttggtgtccaatgcatgaaattctttcagaacttctaccgaaatgctgaccgatgttgccgaaaataccacgcccaagaaaaaacactccaaacgactaaagtgaaaaagcagtcctgacgcccccataattactactggaaaaataacaccaattaccgcaacaatcagagcgggccgtaaatatttttttagcagggcaatgttactttccaaaccagcgatgaacatcaaaataataacacctaaatcagaaaaaacttgaaccaaactatttaattgaatccaattcaaaatagccggacccaaaacgactccgactaaaagttgcccaatgacacctgggacacccatccgttggctgtaatgcccaacaaacaacgttaaaaaaagtactaaagcaagtgtcccgatgaattccatatagttacctccgcaactttacattaaataggtcaaatcacttgcagctgtggggtaagcaaaaattgtttgctttaagttttcaggagttaactgacgattaatagccatcgcaaaatagtttattaaatcatccgcttcaccactcatgaggcttgctccaacaactgcacctgtttttttagatgctattactgtagcatatgccaacggttcgttcaagcggtgataggtaaaccatcccgtcaaatcaaagttttgaacagcataattatttttttgtgtttgtgcttcttcggcaccaacgccaaccttggctaaacgtggcgtcccataaacaacggttggaatcgccggatactgaatagctttagtttcaccagcaaaagattctgccaaatattgcgcttcaaatccagaaactggtgttaatttaggttgtgatttatccacaacatccccgatcgcaaaaatatttttagcagtcgtttgaagatgatcatcaaccttgatcccacgtttggaaaattccacgccaactttatctaaatctaaagtgtcatcgttgggaactctgcctgctgtacaaaagactttatcggtttgtaaactgaagccttgtgcactcactaactcgtagccatcggcatttttttcaatccgactaatatcaacgccaaaatgaaagcgaacgccctgctcttcaagttgggaaaccaattgattaacgtctgcttttgcgaaagctttcagtggtcggtcattatgatgaataatatgaacctcagcacccgcggtaattgccattgccgcaaattcaaatgcaatatagccaccaccgacaaatgacactgagtggggcatattggtcatttttaagaaatccgtacttgttctaaaatgctttttcccatcaatatcaagtaatcccgggcgagcaccagtggccaccacaaatttatcggcaatcactttagtctgatcggctaaaacagtatggttatcaacaaacttaactgatccatcaatgacagtaatcccagctttttttaaaccagccttggtgccatccgaaactggatcggtaaatgtcttctcgaatttgatcaaagctggccagtcaatatttggtgcactctgcaaacctttacctaccaaatatgcagaatggcgccgtgcttcaactgccgctaataaaaccttttttggatcacatccccgattcggacaagtcccaccccaaagattttcttcaataactgcgaccttcaaattttgtgcttttaacgcatatgcaagtgcagagccaccgggtccagcaccaataatggcaacatcaaatttatccatgatttaacccctccgtttttgaccttttgtctacattctaacgcttaacttcactaagataacgtataacctgttgacgattcaaataaccaaccacttgatcagaacggttgacactaacttctgctgttttgcttaatagttgaaaggccatttctagtgtgtcgctttcggtgagttgtggttccagattggttccggtttgttttcgataagtatagcccgttttaatcagtttaccgactggtgtttcgaagacatttttcgcgacggtaccagcaaaaaagttttcaacaaattcatttactggatgttgggcaatatcatccggagtatccacctgtaacagctttccatgactcattatgccaattcggtctcccagtttcagagcctcatccatatcatgcgtaacaaacacaattgtgttgtgcatattatgatgcaaatctaaaactaaatcttgcagttgggttcgcacaattggatccagcgcgctgaatggttcatcaaacagaacaatcggcggtttggcagccaatgcccgaataattccaattcgttgttgctcaccaccggaaagttcacttgggagtcgatcacgatatttttccggatcaaggccgacctgtgacaacaaactatccacaattttagccgtttgttttttgggcatttttttcatatcgggaatgacactaacattctgggccaccgtcatggttggaaacaacgcaatctgctgtaaaacgtaaccaatatctaaacgtaaactttgtttatcaaattccttcagctttttaccgttaaaaagaatatcaccatccgtttgtgtaattaactggttaatcatttttaacgtcgtagttttcccgctaccagacgttcctaccaaaacaaacaattctccaggtttaatcgctaaatttaaatcctgaattgctagattttcgccaaactctttacgcacatttttaaattcaatgattggttgtttattagtcattatttggcatcctccaacaatccatgagaaatcaaatactgtctcgcaacttttgctgcggactctttttttacattgacctcataattcattttttgcatatcttcatcagaaatttttcctgctaatttatttaaagctgccacaatttttggatgactggaagctaatttttcagacatcactggtgctccttgataaggtggaaaaacatgtttgttatcctttaacataaccaagtctaattgttttaactgactatccgttgaatacgcatccccgacgttgatgttcccgcgtttgagcgcttcataacgcaaacttgcttgcattgagctagctttaatatttagatcgtactttttattaattcctttgagtccatccgtccggttaataaattcaagcgtcatgccagccttgatttgactttcaattgacttcaaatcgccaatggtttttaaattatactttttagcaaacgattttctcaccacaagggcaaatgtattttgatatttcatcggcttcaaataagtcatattatattgctttttaaggtcatttcgcgccttaacataagtttcgtgggcgcttaaattcgaattgtttcctgaactttttaccaagctttctaacacagttcccgaaaactctgggtaaatatcaatactcttactcttcaacgcattgaataagaaactggtggttccaaaattaggttttaaagtaaccgtcacgcttttatcactttgttcaatcaagtctttatacatatgaattaaaatatttggttctgatccgagtttcccagcaattacaatattttctttgggttgtgaaacagcttgataaccactcacaccaacaaatcccacaacgattaccccaactgtggcaatcaccgttcgtaaccgtgctgtctgtaaaaatttgatcaaggtacttaaaatgatcgccagtaatgctgaagttacagcgccaattacgattaaggaagtatcattttgatcaattcccaataaaataaagtttcctaagccaccggcaccaatcaatgcagctagggttgccgttcccacaatcagaaccaatgctgttcggattccagaaataattacaggtaatgcgattggaatttccactttaaaaagtttacgcattcgtgacattccaaacgcgtctgctgcttcttctaaagaaggatcaatttcatcaattcccacgtatgtattttggaaaatgggtaacaaagcataaatgaccaaagcaattatcgctggaacactgccaattcccaccaatggaatcaataatcctaataatgccaatgaaggaatcgtttgtaaaacgctggtcacctgtaataaaaactcggccacatttctatgatgagtagcccaaatagctaatggcactgcaatcacgattgcgattaataatgctgttagcgaaatttgcaaatgttcccataacgcttgaagcaattgcgttcgctgatctaaaaaagtattccataaagttgtcattatgacgctcccaataaatttattgcttctattctctcacataacctaaaaatatccatgcaatatactcaataaagctcaattgaccaaatcactagtcaattgagcttttaagattttagctattagaaattgaattttacttctttaggttttgttgcaactaaaatttttccttgccggattgaatacaaaacttccgaacgctcatttagtgcattataaaaattatcgttatttaaaatgatacagtttgcgggtttaccaacttcaataccgtaatgatctgtaatgtgtaaagtttttgcagcattattggtcacaaaattatacgagtccaaaatactttgataacccatcatttgttcagcttgaatccccatatgaacggggtccatcatatttccgttccccatgggataccacggatctttcacatcatcttccccaaatgaaacgttaattccagcttcagttaagtccttaattcgagtgattcctcggcgttttggataggtatcaaatcggccacccaaatgaatgttaactaatgggttagaaaccatattaatttttgccaattttagaagacggaataatttataacagtaggcattgttatatgaacccatcgccgtggtgtgacttgccgtcacgcggtcagtcaatcccgtttcataggctaaagtagccaatacttcaagatttcgagaattgggatcatcgatttcatcacaatgcacatcaatcaaacgatcatatttttcggccaactctgcgatgtaatggagtgattgcacaccataatcacgcgtaaattcgtaatgtggaattccaccaattacatcggctccttctttaacagccgtctctaataattctttgccatgtggatatgacaaaactccttcttggggaaaggcgactaattgaacttcaacaatatccttcatttcttctttaacttccagcaaagcttccaatgccgtcatagtcgggtcggtcgtatcaacatggctgcgaacaacttgaattccgttttctacctgttttttgatggttgcttttgcgcgggttttgacatcttctcgagacaaggttttctttcgctctgaccaaatccgaatcccatcaaataaagttcccgtttgattccattccggttcacctgccgttaaggttgcatcaagatgcacatgagaatcgataaatggtggtaaaagtaactttccgttggcttcaattgtttgttcattttcatgactcgccaaatggctgccaatttcaataaacttttcgtttccaatccgtacatcctgtttattttcagaattttcgataaacacatttttaattaacatgtttctcctccttatttaaattgaacttcatcacaagatagtaaacaaaaccaacaagaatcataacaatgaacgttgcccccgtataatcttcgacccaatttattttctgcaaaagaagatacacaacgacgcccaaaacccacagtacaaacgctagccaatgaattccaccttgataccagtactgacctccttttctggaaagctcctttgcttgatagtttctgtcccgaatcaagaaatagtcaacacacatgatactgataatcggaccgagaaccattcccacatagtccaaaaaagctgtgaaagtgtctaagaagctgccaacaaaaaccggaacaaatgtcacgactgtggctaatattgtcactatccacagcgatttttttaggctaatttttggaaacatattattaactgccgatcctgcagcttgcagatttacggcattggctgtcatactagttagtacaatgacaatcatcgcaatcgatcccagcccaagccggttggcaatggtactaggatctgaattgtttgcatcatacacacctgaggtaatggcaatactgattgtggctactaacccaataaatgcaaaccagaaaacacccaaatctgcaccaatgaacggtgccgttacggcgatatgttttttatttgtaaaacgggtaaaatcagctcctgcggtaacccaagctaagttgaacgcggccagtgtatcaattgcagctccaaaaggcattttatgcatattaggaactttccagtttgtgatttgagaaaatgaaacatcacgaaaaacaacgatcgattcccaaagaacgaaaataattacaagaattattcctattcgttcaataatttgaatcgaccgttgcccggaagaaatacttattaagtgcaaaatgctcataaccaaaataccaaataccagacctttattaccaccaggttgtccatagaccggccatcccaacaatgaatgtaaaatgtacgacatagacgtcgccgcaataaacgtgttaacagctgtccatcccacgaactgagtgacattaaccattgatggtacaatacttccacgaataccaaatgaagcacgagaaatggccatcgtggttgcaccagttttgtaacccatgtaacctacaagtgataaaaatatgtatgaaatacttgacgccacaattaaagctttaataccgccccaaaatccacaagcagcaatgattccaccaacgaaccatgtgccattgttagcgttagcaccaacccaagtcgcaaacatgtcccaataagacatgtgtcggttctcttctggcacaatatctaccgtgtatcgatctttggtttccataaaaaatttcctccttagaatttttacacatttttattgattatacacttcctgtgaaaaaaatcgagaacttttttattgaaatctaacaatctgatgctatcaaccaaaatgcaattacttaatttacttttagctagtgacttctgaagtggggacgcccgttctcaacttgaaaaatctttaaatgaaaatagtgcacaaaccatttttgatagttaaaagcaaatagcataatcaaagtagcacccacaacaagtgttaatatggctaacagagttacagtttcgaagatgaaaaatagcattagaatgctgactagaaaagtcagaattagaattttagatgctaaaaatacaaaatacagtatgcgagctttattagaaatcatttttctatcgtgtatgtaatgcgaactatttttcataaagtttggaatgttgatatttccacgacgaaatgccaattttcgtccttgtggagtagaatgccagcctaaaacaaagatgatcttgtagcagatctcccataagcacaacataacaggtgtcgcaaatagaaaataaataaaagcactaatactttcgttagtggttggaaataaataatttccaatccttcctgttttttgcgaaatccaaatacttgctagaactaatatggcccataaccaccaaatcttagcagatgttttttctacccgttgtgcgttatacatctgcagtgtctgttctacactaaaaccccgatcattctcagtttcgtgcacagtattacaaaaaataattgctttttggatcacgtatactgtttcatctatatcagattgacgggccgcaactaacggaatggctatctctgctttaccatcgatcggcgcctccaaagaaagattaagtgtcgtcactagattacgttgtgtagtcgtaacatctgcaagatattcccacccaattaattttggttttctcttgaagagtactactttatttaacagccctcgtgatgaaaggaccaacaaattcggttttattagtctataaacagtaatgatagacggcaatccaaaaacaagcataataaagagacccataaagtaattatttgaatcatattttgctattaaggttccaattacaacaaaagctgcgtttaacagaagatagagtagttcatataacctgtacgcgtttaaataaaatttcatagcgactccgtccatgcacattcaaggtgcaattagtggcttattttcaataaccgatctcttgattccatttaatttgaagccacttatcggattcggaccgatgaccccttccttaccatggaagtgctctacctagctgagctaaagcggcataaaaattacccaaataagtataccatatccgtaaaatttcggatcaaaagtggacgtgaaaatgaaataattgataagacaacgctggcacatttgcgtgacgtgaagttgcctgatggttttgttgataattacgctgatgttgatggctcgaatcatagtgtttcgtatcgtaatgggattccactgcctggattggattaaaatcttttcaacggtaataaacttgtaaaaccgactaactttgtggtaattaaagaaaaggtttatataatttgaatatgaaatccaaaattctttagttttgactatgataaagaaaccgaaattttaggtaaaatgatatgcagaaatgtaaaatactcaaatctgttgtttccaattattccaatttgtagctgattgtcatgttcatattgaaatataatactttactgtttttctgtaatatgagttttttatagacatatacacaacttaaaaacgatacagccacagactagtgagtggttgtatcgttttttagttcttatcttctctgaaggtggaaaacaattttttaaaagtaaaaaattcgtcaaccaaacctattttttaaactgtttcaaataccgactggcaaataatttatgaaacttaactcccaaagtggggttagccgcatcaatatcttcgtacatagctgtcgtgattttattaaggagggatgacagctgatctagttctgcatcagaaagtgaccttacaaacggcggcacttcttgagcagcagattcaatttcttgtcgacctgcaggggttaagttgactaaattaacccggcgatcttttggcgacttagttaaagttattaagtcacgtttggcaagtttgtagacaaattcactagttgactggggtgacatccctaaacgcgttgcaagttgccgttgcgatagatgatcttcatccgataacgccaataaaatttttccctgtccttcaactgtcaaacgaggtcgtgcttgcttgacaatatcatcgtaaattttgctgagttgttcatactctgccagttttcctgcggccaattctgctttgatttcgtttgtcactatgatcatcccattcatttcatcgttttcttaagtatacaacattccaaaatttgcggcgaatagtgacttgacattttaatcaggtacccttattatatattagtcaggtcacctgataaaaagagaggagtcaaaaacatgaatcacgatagtttaattaaggtaaagaatattcgaaaacaatttggagacaaagtagcagtgcaagatgtttcatttgatatcaagaagggcgaaatctttggtttgctggggccaaatggcgcgggaaaaaccactattttacggatgatgacgaccttgttgcgtcaagatgcgggaaaaatttcgttaaacggctttgatacgctgactcagggtcgtttagctcgccaacagtttagtataaccgggcaaacagcggcaattgatcaagatttgacggctcgcgagaatttaataattttcggcaaactgaatggattaagtcgaggcgatgctaaaacccgagccgtcgaactattaacggattttgatttagctaattccgctgaccaaacattagcaactttttctggtggtatgcggcgccgattggatttagcgattagtttaattggcaaacccgcaatcctatttttagatgaaccaactaccgggttagatccgcgaacacggatgcagatgtggcgtgccgttcaaaaactagttgctgaaggctcgactgtattattgacaactcaatatttggaagaagccgatcatttggcgaatcgaattgcgctcatcgatcatggcaaaatgattgcgattggaacaccaagcgacctaaagaagcacgttggggggatgcaacttcggatagaaatcaccgaccagaaatggcgggtgcaagtccaaaaaattgctcacgatactttggcattacctgttaatgtgagtgaccggactctgacagtgttgattgatgatacaagcatgcagatggttccacaggttttgaatcagcttcaagctgcgaaagttcccattagcaattttgcaattgaaactccgccactggatgacgtttttttgaagatgacagtcggtaaaaattaaggagaaaaaaactatgaaatcgatgacaactaagaatcgttttgtgagcaacatccttacgatgactcaccggaatttactcaaaaccatgcataatccggacagtctcagtgatgtcgtgattgaaccggtgatttttacactgttgtttggatacctatttggtggtgtgatcgccggcagtgtgcaggcctatttaccaatgctggtatccggaattttggttcaaagtattttaaacgccgcttccgggtcaggccaacagctgcgcgaagatattaacgccggtgtctttgaccggtttaaaactttgccaatttcaccaattgcgccgctagcaggtcaattagttggcgacatcttgcggctgttactttcaggagtggttgcattgataaccacctttttgatggggtggcgaccaacagccgacctgccgatgcttgcggcagccctattgttggccatctttattggttgggctacctcgtggatttttgtgctagttgggttaatggctaaaaatgcggagttaattggcagtttatctatgattattattttggtgatgacatttttgtccaatgcttttattccagtcaaaacattaccaaaagtgatacaggccattgttaaaattaacccagtcagtttgacaatcacggcaattagaacaattctgagcactggcaattggggaagtaacgctactttagtacttattagtggcggagttatcattttgatatttatgcctttaacggttttagtttaccaacgccgtgactaggcgagactgattttatcgatgttaccgtcgagattattgcctatttgtatgtttttcacaatggtgaacccgatgttttagtttcgcaagatatcgatagtgaagttcgtaacttcactagctcacgtaaccaagatttacaaaatggctttgcaaagattgccaatgcagcaacaagtgattaattctaggaaagtggtcttactatgagaaatttcatggtagggcctttttttgtgaatcgaagaatttggagtgtaaaataagagtgtcggaaggagcgttcaaaatgaaacaaattaattttaaagggaccactttacctgccatcggtattggcacctggcatatgggtgacaatcccaaaacctttgagcaagaaaaagccacaattctttatggcctgcaacatggtgctacagtcattgatacggctgaaatgtatggcgaaggtaacgctgaaacgttagtgggtgaggcattaaaagagtttgatcgtgataaagttttcttgattagtaaattttatccgcaaaatgccactaagactaaaatgcgacagtcactggagaatagtttaaaacggttgaaaactaattatcttgatctatatttactccattggcgaggaactgtacctttggtcgaaacggtgactgggctagttgaacttcaaaaagaaggtaagattcgccattggggagtttctaactttgatacggaagatttaaaggaactttacgctaatccgaatggagatcaggcttttgccaatgaagatttgtacaatcttgccaatcgcggcattgagtttgacctattaccttggcaacggcaacacggactaccacttatagcttatgcgccaattgatcaaggagattctcgtggtcagaaattgacgcaaaatcctgtgattcaagaaattgctaaggcacaccaagttaccccaatgcaaattttgttggcgtggaccattcagacagatgacatcatggccattccgcaaaccagtaatgtggctcatatgaaacaaaatattgaggctggtaatatcaaattatccaaccaagaaatgcaacaaattgatgcccaattttctgcgccaacttctaaacaatcgttgcggatgatctagatatttttaactaaaggttgaaactacaaaaacttatcttgttgcttgacacgaaaacgttcatagtaacaaaatcagattaaattgccgtctttcagcaaatttgggctggaacgtagtgggcacgacttggagccgcaagccacgtctccaagctcggcctttatctaagcgaaacccgctaagataaacggcactactgagcccatttgcttccagactaagtctaatctttgcaattaacacactggtataatagatttgatatcggtgttgctgcgcattattaaactactgtttttgaaccaagtcgtttaatactagttattgaggtaattttgatactttcaacctttagattcttaacataaaaacctgctaatcacgctcaatatgagaagattagcaggttttatttagccatcaatccgatagatatgttcagtaacatcttccttggtgattacataaaagccattttcttgagaccattccacataaacgagattgcccagagtgttgtacccgagctgtttcaaatttttttgtaaccaagttttggtaaattggtgcgtttttaatactttttcttgaatatggccctgatccaccagcatgattgataaagccttatcttcttctgaatccatgaccaaactaatttgacccgcattttctaaaataacgtgcttggcgttttttaaagaaaagcattggttttgccgagccatctgccggagttgttctagttcaattttattgcgattaatttctctcaaattaagtacaccgtttctgatcaggacggagggctcaccctttagccaccggttaactttatcgtttttctgaacaattttttcaacgaaataaattaaacatccccaaatggcaattcccaataacaagtggaaaacattgatttttgggtcataaagcgattcttctagaattccgcccagaactaatgtatagatgagatcaaatggggtaatatccgacagtgacttttttcctaataaacggacaaccagtaatagtcccattaaaccgataattagtttgatcatgattaaccaaaacatcttgtggcctcctttttaaatataaatttatcgtttgtataaattaatcctaacctaaatggactattctaagcaaataaaatgagggattaaagactgaacaacaaaaagaaaataattcttgacattcatactgtagctgactacaatacaaatatagtgtagcaagctacgataaagaaggggtgaatttcaatggaaaaacaattaaaggtagttaaagagacaaaagggtactggcgtgtaatttttagtaatccacctcgtaaccaattcgatccatggacttttgcagaattaaatcatttgatggatgtggcagaagcggatcaagatttgaaagtaattgtttttgaaagtggtaataaagatttctttatggggcatcatgatgtggccaaacgtttggaagttccagatgagcctggggcccaaccgtttttctataagtggccggattttgtgacgcgtttgattaacagtccaattattacaatttccaaagtgcgtggtcgcgcctatgctcagggatttgaatttgcgcttgcaacagatatgatttttgctgctaaaaaagaagctaagtttgccttagtggaagctggaggtggttcaatgccaggaggtggcggcattgaatggctgactgcattggttggtcgcagtcgggcaatagaaattatgcttagcgctgatgaatacaacggtgcacttggcgaaaaatatgggtttgtaaatcgagcttttgatgatgacaaacttgatgaatttgtagataaattggcgcgccgtattgggtcatttgcaaaacgttctcttcttttgggtaaaaaaatgattaattcgcgagctaaaatgccgactaatggtgagctgtttcaagcaaattacattttacgtactattgacgattggccagaagctaacgcgggtggtcaagaaatgtcagatctggcaaaaaaatatggtgaagatgcagtagagttgactctgcccgaaatgtttgggaaaaaatcaggtaaaaacgatgaaaacaattaatgtcggtttaatcggaattggcacttgggcacaatatggagttattccaattttgaatttattgccgcaatttagactattggctattcaaagtcgttcacttaataaagctcaaaattttgctcaaggccataaagtgcctttttattatgatgatgaagataagttgttacgtaatgacaagatagatttgatcatggtaacgactccagcacccacacattttcaatatgctaggaaggcaattttagctggtaaaaatgtttatacagagtggccattaactaccaataaaacccaatcacaagaattagttgatttagcacaagaaaatcatgtgcgcacctttgttgggtttcaaagaagatattctcccagtgcccgcttttttaaggattttctagatcaaaaaagaattggtaagattcgttcagcacgtgtttcaatcggagttgaagcctttgctagggttatgccggaaaattatgaatggactacgaaatcagagaattataccgatgtgctaacagtagatgttgggcattttgctgatttgctttttcatttggttggacaacctaatttagtgattggtttaacggctaatcaatttaagcaaacgactttgtttgataagaaaaatcgtacaaagaaggttccgtatggtttgcctaataatgtcacggtaatgggcactttactggaatctcagcagttatttgttattaatgcggaaggtgctcaggataatatttctggaatgcaactagaagtaaccggtaatgatggcgtattaatgttaaccaatacacgggcatatcaaaatgaagcagataataagctgcttttacttgataaaaatcacgatacttttacaagacttacgattccgggtaagtatgatacacttcccaaaaatgatttagataatagtgtccaagatgctggttattactatcaagcgattgctggtgatttaatgaatgataaacacacaacgccctcttttgaaacagcagttcaaatgcacgaatttattagtaaaattattgactcaaataaaaaattacgagaaggtgaatagataatggcagcgtatatggtttatgtgcgggaccgtattattgatcctgaagaacttaagaagtacgaagaagaatccagcaaagtaaaggttacaggtgcgaaaaccccattagctttctatggaaaagtagagacgcttgaaggccccaaagttgatggcgtaaccattgtgccgtttgaatctatgaaagctgccgaagctgcctataataatccagattatcaaaaggccatgaaacatcggttaaaaggtgcagattatcgagtcttcattacggaaggtgtaaaataagtaataaataaacttattcggagtgatgatatgaaagatttatgtaaagcatatgttggaaacaatattaaaatggttcataacaaaattgatacgttgtttactaaagagactaacaaattgttttccggtttaacaaatacgcaataccttgtattaatttacttgggtgaagaaaatgataaatgcgctttacaaaaagaaattgaaactaaatttgagttgagtcatccgaccacggtaggaattatcaagagattatctgtgcaagatttagttgtaactcgtccttatgagaaaaacaagcgtcaaaaagaagtcatgattacttcaaaaggtatgagtctgctgacttcaataaaaaatgggccgcgtagtattttgaataaggttgataatgatgcattagctggcttttcggaagaagagaaaaaccaactaaataattatctatatcgaattaatgacaatttgaatgaattttaacaaaaacgaacatgtcgtagcggtggtatgtggacctaacagctatgacgtgttcgttttttaatcatcgatagtatattttttatctaaaaccctatgcggatagttgaagttatttctatgtgtcatgcaatcacagaaaaatgacatagtgtaacaacgacagatttaacaagataattatgaatgttttttgaaaaggccatttagcccataaaaggccagctatttgtgaatcgctatgcctaatgacaaacagctatgactcatttagctgtcaaatcaaagcttgcgtcaatcagattgcaaatttgtttggaatcaactgtcgcaatatcaatagatatccaattactattattcatgtgataagcagggaaaaatccttctgaagattgtaaaatgtcgaccgtttcaggatccaacttcacgtccataatgtcgataacttcttttccttcaaggccaagattctcctttttgacatccatgacaatggcgtaccattttcgattttgagagtgtctcaaaactgcgtagtgtgcatattttttccataaatattcgggttgactggtatatttttcctcaacatacttaaagatttcttcgcgtttcataaaaattctcctattgcacatggtctcgcgttacacgatgcggatattgaaaaaatggcagcaaaatataaagttagtgtgccgcaattagcaattcggtacgactggcaattaggaacggtcgtgttacccaaaactgtgaatccagaacatatgaagaccaatgctgaacttgattttgaaatttcggatgacgacatggcagctctaaaacaggtaaaacctttgaattatggcagtgccagcgtttatccagtctttggtggaaaacttaaaagttatgatggccagacaggatctgaaaataaataatttcaatttagctggatggtggttcgttacaaattacaaatattaaataagaggtccatttattgccaattgcgacagtaaatggacctcttgttagtttaaactatttattttgtttcatacatataatcacgtgtcattggcaagccttcgccacttggtgctttggttaacagatattgcatgacatcaatgttaccagcttcaaatgaagccgcagctgcctgtaggtaaagatcccacatccggcagaaacgttcgtcaaacatgtcccgtacctgatcacgcacgttattaaagttgcgatcccagatttcaagcgttttttggtagtgacgacggagcggttccaaatcttgaatttgaagatcagcttcaatcatgtagtcgaggtttttcgatacacttggaatgtagccacccgggaagatgtactttgttagccaaggatcaacgcccgcaccattatgttgcccagtaatcccatgaatcaacgcccgagcgcccggcttgagtaacgcgttcacttttttgaagtagccaggtaaattatctttaccaacatgttcaaacatacccacactagtgacgtaatcaaactggcccgtagtttcacggtaatcttctaatcttacatcgactaaatcttccaagccgcgtttttgaatttggtcctttgtgtaattgtattgttcttcacttaaagtcaccccagttgcgtgcagaccgtacttttcggcggccacgtacagtaaggttccccaaccggagccaatatcaagcaaagtttttccacgttctggttttaacttcttcaaaatatgattaattttgtttaattgagcctgttccaaagtatcgctgtcagttttaaagtaggcacacgagtaggtcaaggttggatctaaccatagtttgtaaaagtcatttccaatgtcatagtgactttggatatcctttttgttttctgcttccgaatggccttgtttggggatgaatttcaaaaagcttttatcatgcatgaaactagtagcttgtcgataagctgaagcaacaacttgttgaattgagcccttgatatcaatgtcaccatccatgtaagcttcacccaaagttagggtggcgtgcttagcgatttctgacattgctaatttcttgttaatatcaatttccgcttgtggtgtgccttcaccataggtttcagatttgccatcccaatacttcacagtaactgggaaatcaaaagcgttactcaataattttttgtaaactgttttctctaacacaaattctcactccatttctaaaatgtaaacaatcctattttagactttttaggtttgtcacgtaaggaatttgatacgttaaagactagaaaacgatttcattttttgattcatatttcttgacttgaagtatacttcaagtagtagactttcattagaacaacaatggaggttatcaaatggcaaaaatcatgattattggggcctatggcaagacagctcaattactaacagaaaagcttttacaggaaaccgacgatgagttaattttatttttacgcaatgcacaacggttaaacaaatatacggataattcgcgaattcaattagtggatggagacgttttgaatacagatatgttggcacaatcaatgcaaaacgccaccatcatttattcaaacttaggtggcgttgacctggatgatcaaattcaaagtgtgattaaagcaatgcaacaaacagataaaaatcggtttgtctacataagttctttaggtgcacatcacgaagttcccggaaaatatggcgagtggaacgaacaagcgattgcagcgtacttacccggttttcgaaaatcggctaagttagtcagcaattccggcatgaaatatactgagattcgcccagcttggttaacagataatgacgaagtgaactatgaaacgacgcaattaaatgaaccatttaaaggtacggaagtttcaagaaaaagtgtggctgattttgcttttaaagtcatcactcatccggaaacacatgtgaatgaaagtgttggtctaaacaagccgaatacagatgatgataagcctagttggatgtgaggaaattggcatgatagatgtttttgcacatgttttaccgccaaaatttttagctcagatgttacagattgattcaaatgtccttgagaaaaattcttggatgaaaaatccgttattgacagatattgataaacgactagcaactatgcaaccgaatcagcaagaaattttatcaatggtgaatttaaatcctgaagattttgtagatggtgatcaggctgcgacattatgcgaggcagcaaacgaagaattacagcaaattgccagcaattctaccagtagttttccagcggtagttgcgatgctgccaatgaataatattgctgaagcaatggcaattatcgattcacaagtgattaataacccgcttgtagcaggtgtgcagttattcacacgagcaattggaaaagaaattacagatgaaagtttttctccactttttgccaaaatggcagagagtgggaagccaatatggttgcatcctgtgtttgacgaacgtaaatcggataataatctgacatttagttgggaatatgagcaaacactggcgatgaatcaaattgtgactaaaaattttttcactaaatatccaggactaaaaattattgttcattatgcaggtgcaatggtaccctattttgcacggcggattttttatattcagggtgaagctagatatgaagcttttaaacatttttatgtagatacggctgtattaggaaattcaaaggcaattgaaatggcagttgatttctttggcgaagatcatgttttgtttggtaccgatacaccacttggaattaagcctaatggtcccacgagtgtcatcaaacaatcgcttgatcaatccaatttaacaagcatacaaaaggaaaaaattttcactggtaattggcagcagttaattcaaagaataaaataggtttacaactaagaatataaggagtgttcaagatggcagtaacaaaagatgatatgcagtataccaaattagggaaaacagatatcgatgtttctaagatttgtattggggcaatgagctttggaaagccagggaccatgcatgattggtcgcttgattacccagatagcgagaaaataatcaagcacgcgctagggcttgggattaacttttttgataccgcaaatacttattcaaaaggaactagtgaagagtatttaggccgggcattaaaagaaaataatgttgcgcgtgataaagtggtgttggcttcaaaagtctatttcaaccctggtcgtctttctagtgaggcgattcatcgcgaaattgatggttctttgaaacgtttgggtaccgactacctagacttatacattattcatcggttcgattatgatacgccaatcgaagaaacgatgtcagctttaaatgatttggttaaagctggaaaagtacgtgcaattggggcatctgctatgtatggttaccaatttcagaatatgcaacaggtagctaaagataatggttgggctcaattccagacaatggagaaccactacaatctgttgtatcgtgaagacgaacgggaactaattccaatctgtaaacagtggggtgtttcattgatgccatatagtccgttggccgcgggacatttgagtcatcgtgaatggcaagtaaatacgttgcgcagtcaaactgatcgggtagcgatgggcaaatatgataaagcagagagtgaagatgttggcatcgttgcccgagtggacgagctggccaaaaaatataacgtttcaatgagtcagattgcgttggcttggcaatgggcgaaaggcgttatggcaccaattgtgggttccactaaggcgagccatttagatgccgccgttgaagctttggcaattaaactaactgatgaggatgtgcactatctggaagagttgtatgtgccgcacgaaattgtgggtgccattaatcacaacccagcgcaggggactgtgctgattgatgaaaagaagtaagaatctatttcacgagacagtaaacaaatgcttaaagtttttaatttatctgccaaacaaaataccaactaagaatggttcgcaaaagtacctatttcttagttggtattttattcaacaggtaaagtttagaggtataattattggcgtaattttattgaaaataattttgaaatcaggtattcaatatgaatttttcaactgtcaaagttaatgatttagacgttttctatcgcgaaagtggttcagacgacaatccggtatttttattattgcacggcttcccaacggccagtcatatgtttagaacttaatgccaatattagaaaattattttcatgttattgcaccagattttattggttttgggcaatcagctgctcccgaccataccaaatttcaatacacatttgaaaatttgacgaattatgtagaagactttttgaaggccttgagtattgacaagttttatctgtatgtttttgattatggggcaccaattgggtttgaattagcagttcgtcatccagaaagcattttgggaatcgtgagtcaaaacggtaatatttatcaagaaggccttgggtctaaatggaaatctcgcaaagtatactggaatcatccgactgcagaactacgggaaagctataaatcagcatttgccccagaaaccattattggtcaatacactggcggtgaaaaagcaggcagtgtttcacctgatggctatacactggatatccattatacagagtcaccagattacgctgaaagacaatctgatttaattttcgattatcaaaataatgtaaaaaagtatccgcgttttcaaaaatatgtgcgtgattatcagccggagtcaattgctgcctggggtaaaaatgatcctagttttgtctatcagggtgcagaagctttccaaaaagatgataaaaatgcggaaattcatttgttagatggtggtcattttgtgctggaatctcactggcgagaaattggacaatttatcctaaataaatgggcatgaataaacagataatctgacttgttcaaaatatcattcgtttgtgaatggtatttttttatccttcaatttagcgcccaaatgttataataaaataagtttacgacacaacataatttaaatgagcaggaggataaatggtgaccagtagtaaaaatggccattagaggacatatgaaaaaaatagggtggagtttattagtggtcgcgttattgctgggtggttgttcagcaaataatactagtcaggcaagtaagtccgattctaagaagactgaatcatcagtagtgaaaactaaaaaagtaagcaaatcaacttcgcagtcaagtgaggatcaagctagttccagttcacaaaaagcgacctctagaactaaaaaagttgctgcaacggtttggaataaaactaagcagcaggaattagctacgtttatggcgaagtggcaaaaagaaatgggccaaacgtataaaggtacatataacggcgaaaagacagatcatctgggctacatttttccagatgtcattaagaacggtaagttagcaggtcgagtaaaatggggaacccgcaagattaatttaacgtggtctacaaatggtgaaaatggcaatgaatttcaaattgttgcagttgccactggcggaaaaggtggtacatcatttccaacgacctacttattctgtattcacaataatcagccggttgtgtttatgacgcaaaccaccaatggtaattatcttttcgttcaggatacgcaaaacgcagatctgcaagcagaatttgcaaaaattgtgactggaattaagccagcaattttgaccgacgcttcattaaatacggatgttagcagttcagtgaaggcatccccacaacggtggcccagtgcgtatcagggaacttggtattactatgaatcttatgataagaaagtggatactttaaaaccggaaaaaattagcgcggtcaaactcacttatttaaaaactcagaaaataaattggcttgatattcgtggcgcacatcaaaccgcgggtgatggttcgtatgaatatttaagatatcattactataacggccgccagattccggtcatgatgatggctagtggagcagacgcttggtttgacggaaatgcttaccaaagcaaagaaattgcaaatcaaatgaaagactttacgtttggcgacgaaagcaagagtcaagaggatctggactaattatttatgatatgtgcttaaaaaatacgactcaaaatcatttaaagctttgaataaatgattttaggtcgttttttgtacagcttatcaatttacaatttagataagtattcagattttgtgtcatagccaaattgtaattattctgtttccaaaatagcaataaaggcggtctgcataaaaaatagtcgagttgaattattagactttgtgaatctgtgaactaagataaatattgtgatgtaatcataatttttgttaaggagaggatatttgtatgtctactaagtataaatttttagaaccttacacttttaaaaatggtgtcaaagtcaagaaccgggtagtgattcccccaatgacagaggcttccgcttttgaagaaggatctgttacccgtgatgaacttcgctactttagtattcacagtggtggcgttggcttgtttatttcgccagttgcgaatgtttctgaagatggtaaaggatttgaaggtgagctttccgttgatgatgaccgctttttacctggattgacaaagatggcattggccatgaaacaaaatgggaccaaagccattttgcaaattttcaacgctgggcggatgtcaaattctaaaattttacgtggaacccagccagttagtgcaagtgcagttgcggcgttaagacccaatgcagaaacaccaagagagttgactaatgatgagatcgaacagattatcactgattttggcgaagcaactcgacgcgcgattcaagctggatttgatggggttgagttacatggtgcaaatacttatctcttacaacaattcttctcacctcactctaatcgccgtaccgataaatggggcggcaatgtggataaacgcatgacttttgctttagaagtcatcaaaagtgttcatgcagcggttgaaaaatatgcagatcgtccgtttattgtaggttatcgaatttcgcctgaagaaattgaaaatccagggattcgcatggccgatacgcttcatttcattgatgttttagcggatcaacctattgattatctccatgtttcaatgggctatgcttggcgaacatcattaaatgataaggccgacaaggagccattaattcttaaaattaagaaacaggttcgcgatcggttgccattaatttctgtaggttctgtcgaaaaaccagaagatgcagaaaaggtcatcgatgctggaattgattttgtagccttgggtcgtgaaagcttacgtgagccaaagtgggtacaaaaagttgaaactgatgacgaagatagtattcgttacaccatttcaacgcgtgatttggatgagttaggtattacgccatctatgtggaattttgtcacggtcagattaaagtcggcgatgcacatttccaaccaaccagattatgataaggatcaatttgataataaattggcgcctcatgaaggagcttagtttgttgatgatcactggataatctaatttaacagtcacagttcaagcaattgacagagcacaatctgccaattgcttttttataattggcgcgcattgatgagcgaacttcgtgcttaatccccgaaacaagcataatatacaaagtaaatatgtaagtgatgaggtgaaaacatggccaaaattttgtcggtaaatttgggtagttcaacgcttaaatggcggttgtttgagatgcctgatgaaaaacaagttgcttcaggactagttgatttttttggtaatacgaaagcggaaattacggtgaagtacggtgaaaaaaaagccgaacggacttttgataaaaaactaagccttaaagatgctattactattttaatggatgaattaaagagactaaagttagttaaggatcttcatgaaatcgctggagttggccatcgagtagttgctggcggggaagtgtttaaagaatccgtggtcatcacgaaggatattttaaaacaaatcgatgacttagatgtttttgcgccattgcacaatcatgttgaggtcggggggattgaactctttagacaattaatgccgtggaccacgcaagtagctgtgttcgactcggcgtttcatcaaactatgccggaagaaaattatttgtatggcattccctatgattatcacgaaaaatatggcgcccgaaagtatggtgcccatgggacgagtgtgcgatatgtctctaaacgcacggcaaaatttttgcagcgaccattagaagatttgcggctcattgtgatgcatttgggtgccggttccagtattactgcggtaagtaaagggaagtcattggacacttcgatgggatttaccccattagatgggttaattatgaataaacgaagtgggcaagttgatgcgtcgttagtgatgtacttgatcaaaaaattaaatttaaaaaatacggatgacatgctaaatattttaaataacgagtctgggttattaggtatttcgggagtttcggacgatcaaagagaattaaagaaactggcggctactaattcacgagctcagttagccttgaacatgtttgccaatcgggttgtgaaatttgtgggtagctacatcgctttaatgaacggtgttgatgccttaatctttacaggcggggttggtgaaaatagttttgaaatgcgcgaacaaattatgtcccattttggctatgtgggtgccacaattgataagacaaaaaatgaatccggcaataaagaaatcgatgtaagtgcagcgaatgcaaaagtcaaaacgctcgttgtccctactaacgaagaattgatgattgcacgtgatatgtatgaacgcttatcatgataagcgttcaaaattaataaccctcaaaactaacagcaatgtcgttttgagggttattttcgatttattggtgcggccaattttgtttgatttgtttaatgattggtgaaacacgccgtttttggccctttagatagttaaagtagactttcatttgggcatgtttgtcgccaagggggatgcgcacccgattgtcatcttctttagcctgtttcgtaaaacttggatccgatttggaaaggttgctactaaaataaggaaagtctgaatacttcgtaatttcagagaaggcttcccgctggtcttgatagaaaaacttagctcctgggatttcattttgaatgatgtcacgccaaggaccaatgtcacttaacacgataaagcttaaattttctaattcagaaaaacttacggttgactgattagcatgatacataaatttatcaaggttcacagcaagcttttcggtccctaaatattgagagtcaatgtttggagaggcaagctcctgattggaaataattccagtataggcattgttgataagtaaagcggctgcttggtcggcaggaattaagtccgagctgatttgtctatttttagtttccggactgaggagattttttagaaagattatcggccctggaatcacagaaccaatgcgaatttcccgttggttttggtcaaaattgcgtacattatcaatcatctgtttatttgcttgaataagcgtcatcgcttcttggacggctagctgaccggttttggtcaacttgatgtgattaggttgacggtcaaatagttttacacccaaatcttcttctagtttttgcatgccccgcgtcacagttggttgggtgacattgagttgttcagccgttttagctaatgtgccggtgtttgcaaacgttgctaactcttctaatagatacggatcaatcattttatcagctcctagtatacgctgactgtatactagcatgattaagtagtaattttcaaatgattgagtttcttctattataaggatgttgaataaagttatgaacgaaaagtagaaaggatgttttaaaatgacaaaagtgccaatggttaaattaaataatggtgttgaaatgccacagttaggcttcggtgttttccaagtaccagatttgagtcaagctgaagaggctgtcacaaatgcacttcaagctggttaccgattaatcgataccgcaacggcttatcaaaatgaggaagctgttgggcgcgcaattcaaaagagtggcataaaacgtgaggaaatttttgtcacttccaaactttgggtttcagatttcacatatgaccgtgcaaaaaaaggaatcgacgcttctttagaaaaacttggtttggattatatggatttatatttgctccaccaaccatatggtgatgtcatgggtgcatggcgagcaatggaagaagcttatcaggcaggtaaaattcgggcaattggcgtttccaatttttatgctgaccagttaaagaatcttgaattgaccatgccggttaaaccagttgtgaaccaaattgaggttaacccatggtatcaacaaactgatgaggttaagttcaatcagggtgaagatattcgtgttgaagcttgggccccatttgcagaaggtaaacataatattttcacaaacgaaaaaattgcagaaattgcgcagaaatatggcaaatcaaatggtcaggtaattttgcgttggcttttgcaacgtggaattacggtcattccaaagtctgttcatcggaatcgcatggaagaaaatctgaatgtgtttgattttgaattaagtgccacagagatgcaaacgatggcatccttggacaaaaatgaaagtcaattctttgatcatcgtgatccagtgaccattgaacagattttcggttctagtctaaaacagttacaataatcaacttagcagtaaaggagcgtttaaaaatggcaacaggtaacacaccaaaaattaaattaaatgatggcaatgagattcccgcaattggctttgggacttttcagattcccagtgatggttctacttacaaagcggtaagtgaagcgttgaaaattggctatcgtcatattgataccgctgtggcgtactttaatgaagccgaagttggtaaagcaatcaaagatagtggtattccgcgtgaccaagtttgggtaaccagcaaactttggttacaggattttggctacgaacctgcaaaaaaagcgattgatttgtcattacaaaagttgggtcttaattatattgatctgtatttaatccaccaaccatatggagatgttcctggtgcctggcaagccatggaggaagccaaacgagatggtaaactcaagtccatcggagtttctaatatgacaccaaagatttggaataaatttgtgcctttgtttgcaactttaccatcggttgatcaagttgaatttaatccttatttccagcaaaaagaattacgtaaaattttagatgctgcaaacgttaaggttgaagcatgggcaccgcttggtcaaggtaaccatgatttgctaaatgagccggtaattacgaaactaactgaaaaatatggtaaaaatgccggtcaaatgattttgcgttttgaaaatcaagaaggcatcattgtctttccaaagtcggtgcacaccgcacgaattgaaagcaatctgaatatctttgattttgaacttactgatcaagaaatcgcccagatcagtgcaattgataaaggaaaaggaaatcacgatcctgatgctcctggagttcaagaacagttagctagttatgatgttcatgctaatgattaaggtaaactaaataatttttagacaaaataatccctcaagattggttagaaccatccttgagggactttttttatgcttgcagatcagtcatcttgatgataatttttcctttagctcttccagagtgggagtaggtaaacgccgctggtaagtctgaaaaatcaacaatgcggtcaatgatgggatgcagtttatctgcttcaatcagttggcgaataacttcaagttcttgaccactcggtttcataaacaggaaatcatattgaacctgatgaactgtttcaagtttagttagcttatgtgaagctgcgcctataaggagttgtttccagattggtaaaccaaatgctttagcaaaccgggcgttgggcattcccgcgatggacacaattttgccacctggtttgacaatcttaaacgccttttctaacgattcgccgccgagagtatcaaaaacgtaatcgtaatcaaatagaacttcatcgaattgggtttgcttgtaatcaatgacttgatctgccccgagcgagcgcactagatcaatatttttggtactagttgtagttgcaacgaaggcaccgagttgttttgccagttgaatggcaatggttcctacgccaccggacccggcttggatcaaaactttttggttaggttgaatagccatcaggtcatgcaaagcttgataactagttaaactaaccaatggaatagctgccgcttcttcaaacgataaattttgtggtttatgtgcaatgtcactttgagcaaccgcgatgtattccgcaaaagtaccaatgcgatcgtcttgtggacgcccataaacagcatcaccaactttaaaatcggtgacctgcgaaccgatttgggtgatggttccggcaaagtcactaccaagaattagcggcattttgtattttaaaagcattcgtaaatcgccatctttagtttttaaatcgattgggttgatgcttgcggccatgattttgacaagaacatcatttgggccaacctcaggcactggtacattttggatggtgggggttgcttgtttataatgggtaattaaagctgctttcatagttgaattcatattaagctccttgtttattggtttaatcttttaaacattcgataagaagaatattagtgcattggtttaaacttgtcaacatacattcttgacaaagtttttatttcagcgtttaatggtttagaaatatgaacgaacactttaatacaaaagtggtaaaaatttaaggagtaacctaatggccgaacaatcaatgaagatcttaaaaaagagtgcgccaatttttgcaatgctacaggatgaaaatcgccaacaaattttgttgatgctgtgtgcagtcgacaaattgacggtgaatcagataacagagcaactggaattatccagacctgcagtgtcccatcaccttaaactgttattggatgctggactggtcaccgtgacccgggcaggaaccgaaagatattacaccgttcatttgaatggagcgattgatctgctgaaacagttaaccgcatcactagaagcagatttgaatcagcgagaggcacgctattagattgatacgcaatgcctttggactgtaaattgatgagaagaggtctgttaaatgacaaatttacgagaacttaccctgcaagatgagttaatttttgatgattggattcaagcttggaaaaacgaacccacacaagtgtcggtatccagaccaattcagaccaattttgctgaatttattaaacaattacagaccaacagtcgtcatccagaagcacctcgggttccggctactaaatatttttatattgaagctaatcgtattaagggtggtatttcatgtcggtggaaattaaatgattacttactgaaatttggtggcaacattggatacgacgtggcaccggaatttcggaaccaaggcatcgcttctgaaatgttgcagcaagcgttagccttattcaaggcacggaatattaccaaagttttgattaccgcagaagactggaatattgccagtcaacaagttataaacaatgctggtggaatttacgaaaatacgcttatggaagaatccacgggccatcacttgcaacggtactggataggcatgatcaggataaggggtaacactcaagctgccaccacgataaatggcatagtatacatctgcaagttggtaattctgtgtttttaagttttgcatgacccatgcttcatctttgtcaattaattctaatatggtgctatcaattacggtatccacaatcagcgggtatttaacggcatcgtcgccttgcattgtgacggtgagctggccgttttgttctaggacggcacgtttaacttcactgatgtcattgacacctgccgatcttagttttaaggataactcactggcacttaaaccagcacgggttgcaacaccaactaaaatttgaccattttgcacaattgtatgcggttctccagtaacaaaccttcgtaaaaattggttgtggttactgataagtttaacgattaaaacaattaaggtccagatcagtaaaatcaaaacaaactgaagtaacgtgatgtcagtgttatagatcatcccgccaataatgccgccaaggacataattttaaatttggtccactgcgctagttggtgctagatttcctttgccaaggagattaatttggacaatcacgcaaactaagccaagggggaattttaaaccaatatccagataagaaaacatattatttcacctcctgattgttaataatttgtgcacgttgcagatgatagcttgaaaagtcactatcgaaatcaacctgataataacgctgattaatttttaaaatcattttatccgttaaaaccgttttattagtttttagttttttagggaaacattcttcttgtggctcacagtttgtaaaaatcgcacaatttgggcattttgacttaagctagtctgatactgttgataattactgaattgaattccgcctactaaacaagcactgagcacaaaaatgattaacagatctcggtatttgcctttatttcgatgtcgtaagaaaaggattaacataatgacggcaattagtgaaagcacgactaaaataccgtatcgccaaagtaggatgcgattcgtttgagctaataattgttggtatgaataaaatgtcataagcggcctctttttcaaaatttaacacgattttagtataacataggggaatttatcatctgatttgttaatctaagatggtggtcgtttagatttagaattgaattgtgaaggttataggattcgtaacaggaatgaggatggagctttataaaaataatggcaggttagtcattatccatttttaatggtaatgacaagtttcgaggataggctttttcgtttggaagtcgtataatgagattattctaataaaatagggagaataacatggcagaaataacacatttttatgaaacattccaaccaacacagtatgatgtctatttagatgtcaatcgagaaacaaaacaaattgcgggtaaaaccagtatcactggtgaagctaaaactcaaacggtttctattcatcaaaagggtttagttgtcgcttccgttcaagcagatggcaaggatgtctcgttcacaacggacgacaaagctgatgccattcggatcgatttgtcacagactggtgaagtgaagttaaccattacttacaaggcaccgttaactgattcaatgatgggaatttatccttcatattatgaagttaatggcgagaaaaagcagattatcgggacacaatttgaaaccaactttgcccgtcaggcctttccttgtgtggatgaacccgaagccaaagctacatttgatttagctattaaatatgatgaacatgagggcgaaacgacaattagtaacatgccagaaacgcgtgtcgaaaatggggttcactattttgacacgacagttcggatgtcgacttatttagttgcctttgcgtttggtgaattacaaagcaaagtcaccactactaagagtggggttaaagttggggtgtttgcaactaaggctcaccaagctaaagaattagattttcctttggacattgctaagcgttcaattgaattttatgaagatttctaccaaacaccatatccattgccacattcatggcagttagccttacctgatttctcagctggtgccatggaaaactgggggttagtgacttatcgagaagcatacttagtgcttgatcccgacaatactgctcttgacatgaaacagcttgtggcgactgttattgcacatgagttggctcaccaatggtttggtgatttggttacaatgaagtggtgggatgatctatggttaaatgaaagttttgccaacatgatggaatatgtcgctattgatgcgatcgaacctgattggcatatttgggaaatgttccaaacttccgaagctgctgctgctttacagcgggatgccattgatggtgttcagtctgttcatgtgaatgtggaaaatcctgcagaaattgatgcgttgtttgatggcgcaattgtttatgcaaaaggggcccgcttattagttatggttcgcgctttactcggtgacgatgctttacgagcaggcttgaagaaatactttgctgctcacaaatatggcaatgcaactggagctgacttatgggccgcattaggtgaaagctctgatctcgatgtgggtgccatcatgaattcttggttggaacaaccaggttatccagtcgtcacagctgcagttgaaaacggtcaactgactgtttctcaagaacagttcttcagtggcgaaggtaaagaagtgggtcgcaagtggcaaatcccattaaatggtaattacaaagctacccctcaaattatggctgaaaagtcaattacgttgggtgactacgctaaattacgtggagaaaatggcaaaccattccgcttgaatgtggggaatgattcccactttatcgtcaaatatgatgaaaccttattaaaagatattttggataatgtggatgcacttgatgacatttctaaactccaaattttacaagatttgcgcttattagcagaaggtcgtcagatttcttatgccgaagttgtcccattgttaccacaatttgcaaatagtaagtcaaacgtggtgaacgtggccttgtaccaagttgccggaaatttgagaaaattcgcaacaccaaagtcagatgaagaaaaggctgttcaggcattttacgataaattgagtgcagatcaggttgcacgtttaggctggacaccaaaagctggcgaatcaaacgatgatcaattgaaccgaccctatgcgttaggtgcaacattgtatgccaaaaatgctgattcaattgcggctgctcacaagatttttgtggctaataaggatcagttggcaagcttaccagccgacacgcgagttttcattttgctgaacgaagtgaaaaactttggtagccaagaactgtttgatcagctcttaaaacaacatcatcagacgtctgatagtagttacaaggaagctatctgtgcagcattaacaagcacacctgatgccaagttaattgcgcaattaatcgcgaagttcgaagatgctgacacgatcaaaccacaagatttacgggcctggttccgaggcgttttggcaaatgaagatggccaacaagctgcttgggattggcttcgtaatgactggcaatggctcgaagatacggttggcggtgatatggaattcacaacttacattactgtaattgccgggatttttcatacaccagagcgtttggcagagttcaaagcgttctttgaaccaaagctcaacacacccggtttaacacgtgaaatcacaatggatacgaaagtgattgaaagccgtgttgccttgattgaagctgaaaaagatagtgtcaatgcggctgtggcaaaggttgttgactaacctattgggtgataaaatttaaaaagaatagttgaaatgcggcaactctaagcgaggtgctgcattttttagttgatctaaaatacaattcttagtatagaaaattagtgacatccaaaaatctatcagatatgtattgttgggatctgttagtattgacaaggaagcaaaatttttaaagtagtaagagtaagttttgaaaaatagtcatgaaaaaggaaagcagttaaataatgaaacaagcaaacatcagaaatttttccatcattgctcatattgatcatgggaagtcgacattagccgatcgaattatggaacaaacccacacggttagtgaacgggacaaaaaggcccaattgttagatgacatggccgttgaacaggcccatggtattaccgtcaagtccagaacagtgcggaaccattacgaagctgatgatggacaaacatatgaatataattttattgatacacctggacatgttgatttttcatacgaggtttccaaaagtttagcagcgagtgatggggcgatcctattggtagatgctactcaaggcgttcaggcgcaaacggtggcaaacttgcgccttgccaagcaaaatcatttggtcattattccagtgattaacaaggtggatagtgatgcagccgatgtgccacggacacaagctcagattcaaaagttagatccggcgttcgaaaatttggatatgctgaaaatttcagccaaaactgggatgggtgtgcatgaagttctggaagccattcggacaaccattccagcgccaaccggagataaaaaggcaccgttaaaggcgttagtttttgactacatgtacgatgcctttaaaggaattattgcctatgtacgccttgtagatggcacattaaagccagatgattcgttagtattgatggcggagcaaacacacatttcggctaatgcattgggctactttgcgcccaatatgacgcccgttaatgagttaaatgcgggtgatgtgggatatgttgtgacggggctaaaagatccgcaattagttcgagtgggagacaccatgacttcggccaccaagccaacttcgcaaccactggctggctatgaacccgcaaaatcaatggtgtttgccggattttatccaagggacaataattataatgaattgaaatcagcgattgaaaaactcgctttaaatgattcttcgtttcactacagtcttgaaaattcagaggccttgggcgctggttttcgatgtggctttttagggatgctgcatttgcaaattattcgggaacgtttgaaggatgaatatggtttggaggtactcacaacagcacccaacgtgacttatcacgtgtacttgaagggtcaaactgaaccaatgattgtgaataatccgactaattttccggagttttccaaaattgagtatgtggaagagccatttatcaaagctgagattacgacacccaataacttgctaagtgaagtcatgaaacttgcggaaaaacataaaagcacactgttggatatggataatcaagccgatttgatcgtattgacttacaaaatgccaacttctgaagtggcgtatgaatttttcaatcagttaaagtctgtttcccatggatacgccaccttggacacgacttatcttgattatgaaatcgctgatttggttaaagttgaagttgatattaactatgccaccgttgatgcactatcatttgtagttcaccgtcaggacgcgccaaatttaacgcaagaactggtaaaaaaattaaaagttgcggtgccgcggcgactttatcccactcctgttcaggcagttgtggaaggtaaagccgttgcacgagttgatattccaccattgcgtaaaaatgcggctgtttctggcggtaaaaagagtatttccaagaaacaagcgttgttacggcgtcaagggattaacaaacgacaatcagctaaaaacagcattgagttaccacaagaagtatttaatgccattttagagttggatttataaacgaaagatgcataagtgagtttaggcttgtgcatttttttgactaaccttctgaaagttaaaggtttttcattagtttgataggcgacctaaagttcgtcatattttcagtcaatttatttcgttggttttactcagtttgctaaaattaagaaaaatgatataaggaagaaaaaaggtgagattatgcggaaagtacaattttatggcgcaatttctttggatggttatttggccaccgagaaacatgatttacagtggttgttagatacccaaggcggcgataaagctaatacagagaaatttttaaaacaagtcgacaccaccattatgggacgaaaaacatacgacgtgagtaaaggtttaatgaatggggcattgcaatttcctgataaaacaaattatgtactctcgcgaaccaagcatggtgaagtggcagatgcaaagtatgtgcaggaatcaccaatgcaattggttcaagaattattggcccaacctggtggtaatatttggatcgtgggtggtggtcaacttgtagtggatttactggagaatgatttaattgatgagtggtggattcaaattgcaccggttttattgggaaagggaattcggttatttccaaacggtgattattcgactcacttaaagttattggatgtgaatcggtacgatcagttggcagaagtccatttgtgcaaaaagtaaaagctttgataagaataagttttaatttatactcggacaatcaaactggtaaaataaagacaaaaaattatgacgcttgattaacggcaaataaagcaggatggtatccaatgaacaacttaaagaaaatttggttaactcatttacaaccaataatcctcctttggctcgtgatcatattctggatttatcgtaacaatggcctgagtggtttttctgatgcggagaattttggcttcatattttatttaccatttgtaatggcagtaattttctttggctggggaatttggaaacggaaaatgttaccaatgttaacggcggtaacattagtggtcacggcattagttagccctccatttcattttggctatgcattgatcttactgtggttgttaattccaatttgtagttatttatttgaatgtactttaatcagacgaagaagaaaatattctattattgcgttgggggtaatgctgttgtgcataataggaatgtttctaaccccgaagacggcagtacgaatgggtgtgattacaaatgggcatccgaccctagcgctaacaaccaaagtgaagaaaaacaattatgcgaagaaccatacacaatataccaaccgtggagattatgtgattagtcacagttttgtagataaaagtacgggtgcccaatatgacgaattctctattcatcgtgaaggcattttctatattgcaacactgaattataaggaagactgggtttagtgttgtcaactgtaagatatattaatgtgcaagaatgaaggtgaagtacaggataaaggtaaaatcttggttagaagatggtagttaaatggcttggtttttgagaatatgttttaaaatctttagtttataaaatgatcccaagaaagatgcttggtcgacagtcaactacaaagtaattgaaaaagattttatataaagttggcaattttatatcaattataatattcggtttggtggcgaagaaaatgaaacgagacgttatgatctttttttcgtgtattttgtttttttgtctattaggggtcgcgtatggatatgtggcaccaaatgacgggaatctatagcagtagtaaaaagaattcagaattgaaagaaatatctgaaaataaatcgacttatcatttttaattaagaaaaagaatccgaaatttgttattcagaccgattatgaaagtccttacttaaaaaacgctggaagatataatgttactattaatggggaaaagttttgctgccggaattgaataatataagggagattggcgaacgcttgggttaccaacctataaaattaaagtcataggttccttttagatgaaagaaaaataaatgaaaacaattgtcataagggttaaaagcggcacttgatttgacaattcgggaaatcttttcaactatgacagtaataagaaatagagaggttatcacaaaattagatgtaatagaagagaaggagccgttcattattaatattatgcgtatggtaactgatgaaagcataaattacaattcggcaaaaaaattaattttttatatgaggagactaaagatgaatgaacttgaattttttattatcatgatcgtgatacttattttggaagaatttatatttactaatacaagatacttttggttaggtggaattattccttttctgggaacgattggcatcatttacatcttagtagaatcacaaaatattcaatttcaagattacttaattgccgctataggtatcattgtcctattaataatgtggggtgacggtcatgaaaggtattctaaaagaattaaaaaacagaaaaatagaatgtttgaacaggatttaatgaatgaaaaacggaagaagtaattaagcagtttttcagattcctatgtggtgcgtattcttttttgcacaatcggtgtaataaagttcatactcgaaaacgttaacgacaaagaatattaacctgtcgactggttaatacccatacatttacttaaaacaattgcattctctttttagaataggtgtttgacctttttccaagcccattcaaatgtttgtccagcattaagccatttaagaattcttttcttgttctttcaaacgacttttattgtctttgaaccatactaccttctttaggagcaaggaaaattactaacgtcactggtgttatattaggtgcggttcttgatcctggtgcttacattgcaaagacaattgataaacatgataaaattaaaagaaatggttatctagaattctggtgatagtgtgggatgtttaaaattagtgattgaatttgtgattattatgtttctaattataattctacctgaattttttggaattaattatagaattgcaatggttattgcttttcttttatttctaattataaataagataattactaaaattagtggacactcgtttttttattagcagtgtttatgatcgtgttaattatagtcaaatgaacagtttcaaaaagaactccagtgggttctttttgttttatccgatctgaaggtattattgaatagacataaaaaatataagttaagaaaattatggtggagaaattaattgatgagagcaaaaaaatattattagtttgtattagcactttgataatcttaatgtcaaatattatttctaaaacgtggaaaaaaaggcagattcttccgcctagctacgactaacaaacgatccaaagtacgaatcattcgttagtctaggctatactcagaatctaaccgcctcttttcccactcgttctttattattttttaggtgttttcgaatacttaaataaatactgcccacagtacccaaatgcgataattcccgctaggccaatccaaaaacgatccgataaatctccttggcggatctgattgatcacgacgcctactaacccaagaataataagggcatctaaaattaacagtatgatagttgaaattttcatatattctcctaattattcttttttatcattaattggtatttcccgtttcaaaccactggcaccacgcaaattacgaatcgttcggaaaaatgacacaatcaaaaccgcgtttgaagccaaccaagccagtggaccggcgaaacatgcactaataaacccaaacattggcaccatcacagccccaataaagattcgtgaaatcagctctgcaacccctgccatggttggtgcaaaactttgaccaagcccttgcagtgcataccgcacaacaaacaaaatagaaaggaggaaataacttgtactcacaacccaaaaataagtttgcgcaagttctgtgacatggggttccgagtttccaataaagaggttaaccaacgcatgactatttaaaataatgacagccgcaataatcacactataaaccaccgttacagtcaaacattggcgaataccgatcagaatacgatcgtaatttttagcgccaaaattttgggctgtaaaggtagccatcgtaattccaagcgaaaccattggctgggtggcaagctggtcaactttaccagccgcagtataggccgcaatcgattgcggtcccagctcatttagcgatacttgtaaaataatggacccaatcgcaataatggaagcttgaaaacccattggcaaaccaattttaagctcttgtttgatgattgcacgatcaattttcatgtcagcgcgggtcacatttaattcgggaattcgacgtttaatataccaaatacacatgatacaagacaccagctgcgcaaccactgtggcaattcccgcacctgcaatgccaaaatttaatccaataatcaaaacaatatccaaaataacatttaaaacggccgcaataattaaaaatatcagtggcgtgcgactatttccgagtgcccgcaacatatttgaaaacaagttgaaaaacattgtcaccgtaacacctgcaaataaaatactaataaaggtttctgcaccatttaataagaccgcaggagtttgcatgacttgcaagagcgggcgtgccaaactcacacttataattgttaaaataacactcatcccagcacatatccaaatactattagcaaaactcttttttacgcctctaagattaccatttccaaagtcttgcgctgttatgatcgataaaccggttgtcatcccttgagcaaatccaataatcaaaaagcttaagcctccggttgcaccaactgccgctaacgcgttgacaccaactgctcgcccaacaatcagagtatctgacattgtataaatttgctgaaaaatatttcctaaaaacaacggaatactaaaaaagatgatccctttaattggactgcccttaatgagcgaattgtccattttatgcgcctcctctgaccgtaatttcagtatagaaaacggtttctacatttaattaagttagttctatactataacttgtttcatacaaattacaacgaaataatttacttttttaattactaccttttcctccacaaactccttttcttacttttactctcaaatattatataaagataattaaacaattttgttttgcttagaacacgaacgttatagaaaacaatttaattattttacgtatttagcctagaattttcttttaaaaacagttattattaacgtacatcataagaaaagaggaaatttcatgtcaaagttttttgatttagagaaaaacggcaccaaagtttcaaccgagattactgccgggattaccacattttttgcaatgtcatatatcttattcgttaacccagaagtcctcagtcagactggaatgcctgctcaagctgtctttttagctatgattattgcctcggttaccggaaccctcgtcatggggctctttgccaatgtcccttatgcgttagctcctggagttggcttacaagcgtttttcacttataccgttgtcatgtcacttggttttacatggcaagaaggtttagcccttgtatttttctgtggtgtcatcaacattgtgattaccatcaccaagattcgaaaaatgttgatcacagcaattcctgaaactattcagctggcaattagtggtggaatcggtgttttcatcgcttacttggggttaaagaatgccaacatcctgcagttttccagtgattccagtagcattgccacaattaatgggcaggcttataactcagccgtaacccactttacacatggggtgaccagtgtcgtctcaaatggcgggattactccttcactaacccttttcaacaattcaagcgttgttttagctttgatcggaattaccatcaccgtgattttgcaaataaaaaaagtgcctgcaagtattttaatcggaattgttttaaccacgctgattggaattcccatgggcgtaacaaatttacatatttcaagcgctaactcgttaatcaattcaattggtgcattaaaaacaacctttttggcggccttttcttcacaaggaatgggctctttattcacgaacggtcatcgtattctattagtattaatgacaattctttccttcagtctatcagatatttttgattcgcttggcacctttatcggtaccgggcgtcgaacaggaattttctctgctgaagatgaaaaagacctcgaagataaaccaggtttctcttccaaactagatcgcgctttgtttgcagattccatcgcaacaggtgtgggttcaatctttggcacatcaaacattacaacctacgtcgaaagctccgccgggattggtgctggtggccgtactggcctgactagtgtcgtcgttgccattctattcttactcagtagctttgcatctccactactttcagtaattccagatgccgcaattgcaccagcattgatcatagtcggaatcatgatgatgagctcatttcaaaaaattaactggtcagatttcaacgaagcagttcccgcatttatggcatctatctttatggcgttttgttataacatcacctacggaattgcagcgggattcatcttctactgcatcgtaaaaaccgtgactggcaaagccaaagaaattcatccgcttatctggattgtgtccgcactttttgttatcaactttacagtgctggccattgcctaactcaaattataaataaacacaaagatgtcgttcgatcgtttggactaaaaaatccaaatgatcgaacgacatcttttcttactgtttaaactattttagtttaataccagccgtttgcttgccagaaagctttagcagctgaccatgagccataacgggaagctacgtatgaattagcaaccttttcttggttagcggctgagtagtcaccatttaagtatgatgagctcaattgatacttaccaatgtattgaccgtttgtagctgtgtatgagccaccagattctttgttagcaatccaagcctttgctgacgagtcactaccagttgttgtgcttgttgagctagtagtctttgctgtgttcttgtaagtgttggttgtggaactcttagctgtgttttgtgtagtttgtgaactttgagtgttttgtgtgttttgtgtactttgcgtatttgcagtattagttgattgacttgattgtgtagctgttgatgtttgagcagcagtaccgtcagtcttaatcactaatttttgacctacataaatgacgtttgcgtcagaaatgttatttgtcttagctaattgttgaaaatttgtgtcatgcttaaaattgtactcgattgctgaaagggtatcaccagatttaactgtgtatgtttcgtctgcactagccgcagttgtccaagcaattgtccccaatgcaatggttgataagaatgctactgaaaacttagtaaatttgtttaacttcataaaaataaaactctcctctttgtttatgcctttttattaaccaacggatgctatgatacagactcaacgtatcaaagaggtttcgctaatatatcagttttgctatttctgtaatattttgtaatctttctaaaatgttaagcgcttcattattttcagcaactaaaacttggtcacaaaaaaacaattccaagttagtttcaactcagaattgttcgaatttaaaatttaatttttagtttaataccagccgtttgcaacccagaatgctttagcagcggtccatgaaccgtaacgtgaagatacgtatgagttagcaactttttcttggtttgcagctgaataatcaccatttaagtatgaagcacttaattggtatttaccaacgtactggccattacgtgctgtatatgaaccgcctgattctttgttagcgatccatgctttagcagatgatgagctacttgttgtactactcgaacctgtggtagttgttgttgaagcagtcttttgtgttgcgggaacagtagcaacttctttcttagtagctgccttaatttcgccatcgctcttgatcaacaatttctgaccaacatagatcaagttaacgtttgagattttgttagctttagctaattttgaatagttagtatctttattcaaactgtattcaatacctgaaagtgtatcgccagatttaactgtataaatttcatcagcatttgcagctgttgttaaaatagttgaacctaatgtcactgttgataaaattgctactgaaaattttgtaattttgcttcttaatgtcatgtatgattttctccttgtttgttgtgtttgttgtttgttatttaatttatcctcattatgttaccccctcttttttacaaaaggatgtcaaaaagatatctatttaggcgttttctgcaatgttttgtaatcgtgaagctaaaaagtgcttctaatgcctatggttatctaattataaaaatgacaaaattcatttcaaaaacacaaaaaaatcagtaatttcttgtaaattactgattttcaatcacttgtttattatatttttactagaaataatcccaaagcatgggtgattcactctgtaaagcaagccccagattttgaattgactcaatattacctgtaatttttcccacttgctttaagtgaatcaactgacgataacccataaacactttagttaagttttgaatatcaagatgaatgtcagctaagtttcgctcgttttcgctaattttctcaaagcttgtgccatttacattcacttttaaccgccaaataccattattctgtggaatcagctcatctttgacgccaagtcgtaacgattttaccttttgaataaatggataagtatcaacaaatttttgcagattaataattctggccatcatgtacggcataattttcacattcacaacatacggattagccatgacatctggaaagcctttaggatctccagatgcgtactcaaactcttcaaacatcgattcatgttggcatataaaacgttgcaaatattgataacttaactgattggtatacattatttcttgaattttgaacgtattaccagctgcctcataaatcacgtaacctgaagcattttgaccatcttctaggtaaacaccaacctgccagcgtgggtgttttaagcctagatagtgccaccaccaattctcacgttttaacccgccgtttcgactttgggcattattttcataaacctcatcaattaatgaaatggcgtcttcaagcggcaatcgcaaaaactgcccgcgttcttccgaaagctttacacgtggtaaatctgtatttttaattttgtaaacagcgcgatcaaaaacttcttcgtaaccgaatcggcgataaaattcataggaaaatggcgctaaataggatagcgcaacatcatcactacgcatatcagcaaatgcttgccgcatcaatgcagtaattgcaccgtgcccgccgaattcgggataactcattacatccccaatgccattcatcttgtacgtcacaccatgaaaattaactttgaaaggaatactgagcatgccactgcttaatttatcgccatttaaaagtccgtacacttttgaatgttcataacgatcattgaagaaggcgcgtcgctcttcactatcctgattattaaatgcgtataaatataactgataaaactcgtctaaattttttgcggtaagtgtatgaatttcgctcattgtgatggcaccttcttattttctttatttctttgctttttctcgcagtttgcctacatagaaaccaaaggctgtgaacataatgatccccacaatgtctaccaaaacctgtgacgaaatgactctcagtttaagtacagtcgtaaacattgccaaagcaccaatgacaactgctccaatgattcctaataaaatgatttttcctgatttcatattttttccttctatattataagccagcgcatttcacatttcacaataaattcaaaacatttgttatttttttcaatcagtacgcctaataggtcagcattttagttcgtttcagcgttagttagaacttcttttgcaaccatttgtttttcggcaactttaaagaatggataatatgccgctgctgcaatgactaattcaactgcagaccaaactcctgcacgccaatcccagccagttgccattagaggaccaataatcggcggcattgtccaaggaaccatcgtcacagcaggtcttaatagatgtaaggccatcaatgcataagtaccgacgactaaaatttgaggtaacaatacgaatggaatcagcgtaattggattcataacaaccggaaatccaaaaataacgggttcgttaatttcaaacaaagcactcggaaaagcaacctttcctaattcgcgataagttttactcttagaagataacatccagaaaaccaacataatcgtggctcctgtaccacctacgttgacaaacagacttgaaaatccggttgatgtgatgtaaggaattgcttgatgatgggaccatgcagtggcattggcagttaaaaattgtagaaaaataggatcggcaattccttctaaggtcatatcgccatgaataccaccaacccaaagtaaactaactagcagtgtatagaacataattccaggtaaactattcatcgcaaaaagcaatgggtggaaaatattttgaatgaacacattgatgtcaaaatgaagtggaactcgaattgtccagaataagagcaaaatcacaaaaccaggaactaatgaaacaaacgaatggttaactgcagttgggacaccatctggcaatttaatcactagatttcgtttaacaaagaaatttaatatcagtacggatgcaaacgcacaaacaattgctgtaaataatcccgatgacgcaaaattagcggtgtccaagatattcttattattgaacgacacaatcacaaaggccattgttgaaagccctgcaccattgatcgcatctaaatctaaattcttggcaagttcatagccaatcccaatcgccgataacaatgaaataataccaaatgatccgttaaccgccacactgatggcagacatgtatggcttcataaaggcggtccacgctggtattggaatatttccaataattaaaaataccgacccactaataaccgctggaagtgtcataactaacccgttacgaaccgcaaccagatatttgttattaccaacttttgctaaaggtggcattaacacgttttgaatccaattcataaaattcttcaaaataatcaccctcccataattaaattacacgccaagtatagaagctcctcagcaaaatgtaaaccctttcaaaggatgtttagttaattaaacgtaatatttatgaacaattgaaataaatatcctactagtaagtcatttattcaaaggtatatacctttagtaccgttattgatccttatttatccgtacacgtaattttaaacacagatattttcccaatttttttattctggaccgattgcagcgttttacctccaaagcgctacgcattttttccagtttctcactatttcttttttatatatgctatttaatgaccaagggcccttggatcttagtttataaggagattcaagaattggaaaaacattcaatacaagctggtttcaaactgctatacacagacaataacaaaaaaattatttacggagctgctaaaagattacacataatgccttttcatccaaattacgatgacttcattcaggaaggggcactttcttttgttcaggcctatgttcgttatccagataacattgagcaaaacttggaaaaatttagagtttttgcttatcaagctgtttattggcgtcttttggacttaattcgccaaacaaatcgacatactgaacgcatccaaagtgatcaagacgcactaaattcacaagttcaatccaatttagatcatgcctatgaggatatttatcatgatcaattatttcgacatctttatcaaaactgtacaaaatctgaacgactgtttctgatagactgctatgttttgcaactaaaaggttcagaaatcgcaaaaaagcatcatgtcacacgccaatgcgtatccaactggcgacgcactgttggaaacaaagcacttgcttatatttcaaaaagtaaccaataattcgtttaacaatgttaatatatatagggattaaaatatatgatacgcatggatattgatatgaggaggaaactatatggctactagtcattctgattacgagacgatttctacaatttcagcactgattcaaaaggttgataccgatttgcagtcaaaattttctgtaagttttgaacaatttcgcattcttgattttattaagaatatctatcctaaacaaactactgtgagtgctctggccaaacagtttcattctagcaattcagccacctcacgaaaagttagtgtgctatataaagaaaatttaattcaagatcatgtctcaggtgaggatcgtcggacacattggatcacgctagctcaaaaaggcaatgcaattattcacgatattaaaatcgttgtagattcgggactgcctgatctcgaaacaaaaatattggttcttctttcaaatacaattaagaatgataataaatagtcatagaatttagtttggtattgctgtgaaattttagtaataccaaatttttgtttttagacaattagtcaactatataactatttggaaacatttaagttatccgcttgcaaagactaatatagttgtggttcaattacattaacggcgttgaatattatctggcaataatatcttcaaggcataattaatatacagaaagaggacatgttatgcaacgcacaaatcctttggaatttaccaacttctcaaaaatatatcgtgtgtttcttcaaatggatagtcatttaaaaaccgcctattcaattagttttgagcaatatcgaataatggcttatattttgtcactcgaaagcaaaaaagccagtgtaagcgaagtcagtaggcattttgaatcaagttcaccggcaatttctcgtaaaattcgagtcttattcaatttaaattatatggtagatcatgctgatagcaaagatcatcgagtacactggttaaatataacaccagcgggaaaacaacttgcattaacagttaataattttttaaatgaccggatccctgaactaaaaattcagattgactctttattaaaggatgacttaaaaaactaaccattacaggaaacaaaagaagaggcccggaaaacatttttcctagcctcttcttttgtatgcatttttaatcaacaatcttgatggcaatttttccgcccgcacgactaacaatctcatctaaagttttaaatgaaacatttgcgcgaccactttccatacgcgcaatttgcgactggcgcttgccagctctttcagctaattgagtctgggtatagccattgcgaattctaaactgtactagttcttttgctacttgtaccttaattccttcgtcgtccgtaactacttgcttatccattgttgctcctccatttaattaactattttatagaattttcaataaatctaatggttcttcaaaaatgtaatctgcttctgcaaaatcagcgctcggaattgcgccccatttggcattaccaaaatcaattccagccgcatgtgctgcctgcatatcatattgggcatcaccaatatacaagaactgattcttagccacctgaggaaacttattcattcctgcaattaaaggtgctggattcggcttatgctgcttggtgtcttctgccacaactacttgctcagcatacttcgtaaatccatattgcgcaacctgtgtttgccaaccatacttggtcttagaagtgacgattccgatagaaatgccttttgcttgcaaagtcttaaaaagttcgttcactcctggaaaaacactcactaaatcctggtgcttcaaaaattcttctccataatcttgaacagtttgttttggattaggtgcacccagtttttcgaagatctcaaccgctgacagtcccataagtcggcgtgtttgcttttccgatactggaatttccaatcgcccgaagacttttttcaccgtttcccatacagctacatccgtttttaaaagcgtattatccacgtcaaacaaaataacctggtacatatctagcccccctctactttcaaatgaaacaaacaatgcattatatcataagtaagcgatttctctcaatgctgattttgaaatttttttaattgtttcctttttctgccgctgtcctttataaatacgcatttaaatcaaaaagagccgaagaaaagtgaattggtaaactgctttacgacagctgtttcaacttttcttcagttctttcatttaaagcccatttagtcttttactttccttaaaccatgttttgtttgtggggaaacaaaataataaataccaccaatgacaactggataaagtaacacaatgagactttgtaatagcatgccattaccgacaccattaattgcgtagttaaacgcgctcatggcatgtgtcactggcaataattctgaaattgcttgataaacggtagtcagcatcgatgttggtaacaagacacctgctaactggactagcattagaactagtgagaacaggattcccggtgcaccaaataataaatcgatgaacacacacagcgctgtaaaactcatcgcactaacaccggccgcaaacaccaattcaactggatgaatcacctgaataccatcaatggcaacaaatgctagaacaccaaccacttgaagcaaagtcaataagagcaacatattgtttgataacccaaacccgttatgacgatgacccttacgacgcgcgtactgacctaattgattgagaatagccgcaatgaacaaaatcatcgcaacaaccaacggtgcaaacatatttttaactgagcccactgaatctaaagtctgatcctgattaactggattcacaaagtggtttacattttcaggttccgcattcacattttgaacctgttgggcaccatcttgtaatttagagtttaataacccaattccaagtgtcgctgtcttaagtccatcttgaacttgatcagaaccgctggctaactgatcagcacctgttttaccttctttagcaccagattctaactgattagcaccactggttaattgagaacttgccttagttaatttggttccaccagcaactaatttatttgccccggttgataattgcgttacgccactaaccaaagtgggcacctgactattcaacgtttgcaaacctgtacttaattgttgtgatccagaattcagcttggatgaattattcttcagagtggtcaaaccaattgttaatttgcttgaacccgccttcaattgactaacaccacttaccaaactaggtacctgaccattcaacgttgaaagtcctgtagttacttggctggatccattactgagttgggtgacaccacttgttaaacttggtacttgactgtttaaagagctcaaaccagcttgcatttgagtcgctcctgaggtcaggctactattactagcggccagttgtgaagcacctttactagctgaactaactccagcggtatatttagaaacccccgttgtgtaggttgtcacaccagaaactaatgagttttcaccatttactttatcgtttaattgtgtcactcctgcagtaaattgtttgaaatcatctaaattgtcacttaacgttggtaactgtttttcaagagattccaaagtttgaaccgtggtatcactcattaatggtgatgataacaattcatccgcttgactcacaacactactcaagcttgaaatggcagtggttgtactactatcaatgttgagcttgccaagagttgtagccaaactacttattttatcttttgcgctacttaggctttgtaagctagtcccggtagttgcaatctctttagctgaagcggcagcgtttgtagcactgtctgtgacctggcttttagcttcggtaatttttgccttatccgtgctacttaagttggaagtatcaaccccgcttaaaatggtcgccactttttgactatcagttgccgaagtcttcgcctttgttgctgcatcagttaaggcacttgatgcgctatctaagctttcaaaggcgctgttcacatctgttaaactgctttgtgcatcgcttaactcagataagacactgcctaagctcgaaagttgttttaaaaccggttctaattcttgcaacttagtttgtaattgctgtgcgctcgcaatcgtggttggcgcatctttcaaactttccatcgctgctgaatcagtttccaataattgttgcatttctgcaatttgctcattggcctgaccagcggcggtatttaattgtgagactccttgggaaagctgagttgcacttgtaagtaaggaatccgaaccactattcaaggttgatgagctggcacttaatgtattcaatccaccatttaaactagtgacaccattcgtatatgaagtcaccccagacgctagacttttggaacctgaacttaactgtcccacgccactagccaatgcaccggttttacttgataaagtttttaagccggctgagacttgtgaagaaccgttgaataactgtaaaacgcctaatggcaaggccacagttttatctgaaagttgagccaaacccgtgctaagttgaccagctcctgattgggttttggacacgccggcagtataactctttactccggtattcaactgttttgccccagtagttaatttctgaactccacttgctagaggatccgtttttgatttcatttcacttaaaccacttgcaagggccttactacctttagccaaagtatcgacaccagcggtatatgtatcaatgcccgtgctgagtttcttggtgccactttcaaaggtaatcatgcttgttgccaaaacatgtaagtttcgatcaactttagcattaccatcctttaattgaaccacaccgttcttcaatttcttcacaccattagaaccactcttgataccagttccgagttcattaattgaagaaagcaatgttttgtcataggatttttgaatgcttgataccacctcagttttaacctgactagcaacctgttcattaatcacctgtgacacatagctattatgtttggagagtttaatctttaaattactagctttgggattcttgtccaaagcagtagtaatattttgagaaaagttttttggaatgataatggtcatcaaataatgacccttcttcatttctcttttggccttgctggcagaaacaaagtgccatttaacctgattattatgactcagattttggatgacttgttttccagcactcacctttgtattctgaaattttgctgattgatcgttgttcacaaccgccacatttgtattagtggtatgcgtttcctgcgaagaattgatgtatctaaaaataagacctgtcaataaaattggaattaaaagagctaacaccaaaaaactccatcttttcgttcgcggttcccaattcttaaaaatcatctcttgccatctcctgtttttcacgtaatcaaatcacttacaagttaaaactttaatatttgctaaagaaatcgtcaaaagccaatttattttagttaattgtctatttcaaacaaaaatagtccaaaaccttaattagataaggccttgaactattttgaaaaatattatgaattattttatgaaaacaaatgaaaacaaatgaaaacaccatattaccggcgcttatcactcttttcacaagataagtgacaaagcggttgatttgaaacataaaaaacttataattcagtcgaacaagctcaaataatttgtaaaaattgcccgcatttcgggatgatcaagcatcatttctggatgccactgaatacccagtaacggatgaatggcatcctttgattggactgcttcaataacaccatcttctgcccgtgccaaactttctaaaggttttgctagttgtttaatcatctgatggtgcaatgaatttaccaaaattttattgcccagaactttttgaagattaccatcaaccttaacgacatgtgtagccacatttcccaaaaactcaggagcttgatcatgttcaacagtaactgatcgtttcatgagcgactgatcttgatacaaggtcccacccagtgcaacgttgattaattgcaccccacgacaaatcccaagaatcggtttgtgagtctcccacgctaatttaaataaggccagctcaaacttgtcccgtttcaaagaggttgtttttagtagcggatccggttcttgaccgtataaactgggggtgacatcctggccacctggcaaaaacaatccatcaatattttcaaagtactctcctgccagttcttctgactgaatcggaataaccaccggcaaaccacccgcttgcgtaattgcatcaatgttgccttggaacgtataagttgcgtgattatgataaaagatttccgaatcaccagtgaacacgttgcccacgatgccaattcttggtttcatatttcttcctccgtttgtgattgttatgtatactaaagcaccaaccctggtcaccatcaatttgtgactgacttggtgcttttagttgctacttatttaattccgctgagctttaggacaactcagaagaacagtcagaagtgcctaagcgtaattcctgcgggattgcgatcccacctccatgcccttctactgcattttttcgctgagcttcaggacaactcagaagaacagttacaagtgcctaagcataattcctgcgggattgcgatcccacctccattacgcttaggcacttctgactcccgttcttcttcgttcactactttaggacaactccgcaaatcaggtttagataattaagcggggttcccgcgggattacgatcccgactccaccccgcttaattatctaaacctaccgatttgcttcgttcactacttactaatatacgccgtcttataattccactgcgtaccagccgtattgtgaatcacattcttcacctttggattaatcaagaatgaataatttgtttgatacaacggtgcaattgccgcctgtttaaccaccaattgatccgccttaatcatatccgcccaacgtttactcttattattcgcatccgaattttgggccttcttaattaacgcatcataactactattattccacttaccatagttataaccactatttgtcgttaatacctgtaaatgcgagattgggtctgtaaagtctgcaccccaacccgacacataaatatcaaagtcacccttcgctgcacgagaataagccaccttatccggaatattcactaagcttactttcattccaggtaacttattctgtagttgtacttggaaatactcagaaatattcttgtcatcattatcattcgtcgacatcaaagtcacatttaacgattttgcgccaatttccttcaacccttgtttccaaagttttttggctcttgtactgtcataattaacagttcctttcaggtaagcctcatctgcaaagtccttacccgtcttgggatcattagccaaatcagttggtacaaaaccctttggtgtcgttgaagcatcgccaataacctttgtaatcaactgcttacggttaattgccaaagaaattgcctgacgaatatgtttattattcatcgccttacgaacctttgaattagatgccttaaagttgaacgctaagaaacgcgtgatactatacggaacagtctgataatcggaattgttcttaaagtttttaatttgagtacttgaaagctgtgccatatccaatttcttggattgatacaaactcaaaattgttgaaggattttcatttacagaatagttaatcttactcaatttaaccttactcttatcccaatactgattgtttttcacaaatgaccagtgatcattggtacccttccaaccagtcatcttgaatggacctgtataaaccatatatttagacgttgtcgcatacttactaccgtacttttcaataactttcttacttaccggtgagaataatggatatgtcatcagaactttaaaatatgcaattggttcgtctaacttaactacgaaagtctgcttatcaggtgccgaaacacccaattttgaaggcttcaattttccggaactaatttgatccgcatttttaatacctgagaataagtatgcatattgtgacttcgtggttgggttcagagtccgttgccaagaataaacaaaatcttgagcggtaattttttgaccattgctaaattttgcatttttgcggattttgaatgtccaagttttaccatcttttgaaactttacctgatgaagccagtcctgcgattggtttaccatttttgcctaatcgataaagactttcaaatacgtttccagtatgtccataacctgttgctttcgcaatatcgattgtatccaacggtgcatcggctgataaattaagtacttgctttgtagctaatttcccggaaccacctgtactgctctgattaccacaaccagctaacaccaatactagtgcagctgatacagtggctaaaagtgtccattttttcttcatatgatctaactcccctaaaaaattattttagaaatctctttgtacttcaattacgcgaaattctttgcctactttttaaatctattttcattgaacacggacaacaacctggtgacatccaacatcacgtcccttcaaataccaaacaaaaaaccgactaactacattgcgcaattagtcggcttcactttgacctatgttaaaaaactaggcccatttttgcgaaagacaattacagtttgaagccacacaaataaccatgttgttttgacaacatgcttcgcaacattcaatttgcattcgtaacttcatcataactatcttcctttctgtttggttatttcactacttagactatccaattacttattgtaagtcaagtaaaaacctaaatttttggaaattatttttgaaacttgaaaacgttcatgaaaacgatctcgtgtttttggtgagattgtctggtactgaaaattggttagacactttcaatctttgtttgcgaaaacatagaaaagggcagcttctgagcttagcatacgctaatgctcaaaagctatccaccctttttttactctacttcttttccattactttcaatcacttttttataccaataaaaacttttcttcggtgttcttgagtaatcccctgtttgatcatcatggcgattcacataaataaatccgtaacgtttcgacatctgtcccgtacttgcagatgccaaatcaatgcatccccatggcgtgtaaccaatcaaatcaacaccatcatctagtgcctctttcatagcttcgacatgaccacgcaaataatcaattcggtaatcatcattaattgaaccatctgcctcaaccttgtcataagcacccagaccattttccacaatcatcaatggaatttgataccgttgataaacctggttcaaataaatccgcaagccttcaggatccatactccagccccagtcactgtatttcaaataaggattcttggtccctgacgacatattgccattcaccttttcttgtttttcaggatgaatggttactgcaccagatgaatagtaactaaaactatagaaatcaaccgttccatccttcaatgttttggcgtcgcttgggtcaatctccaaatgaatatcattatcccgccaatattttttggcaaatgctggataggctccacggacatgcacatctccacaatagaaattgttcatttcagtctgttgttgtgctagtaaaacgtctttaggatccggtgttaatgggtaaacttcagaacctgcgatcatacaaccgactttattttctggattaatttcatgggcaagtttcacagccttagcacttgcaactaactgattatgcacagcttgaaatgcgttttggcgttgttctttcgtcacacggtcaaaaatcgaacttccatctttgacgggcacaccggcttgaatataaccaccgccaaacatcagcgctgtattaatttcattgaaagtcagccaaagatgcacttcatccttataagattcaaataagacacggcaataattttcaaagaagtcaattacttttcgacttgaaaaaccaccataagctgcagttaaatggtaaggcacttcataatgcgaaattgtaactagtggttcaattccatacttgtgacattcttggaaaactttatgataaaaatcaatacctgcttgattaggcttttcatcatccccattaggaaagattcgcgtccagttaattgataaacgataaactttaaagcccatctctgcaagtaatttgatatcttctttatagtgatgataaaagtcacttgcggtatgtgacggataataggcatctggatccactttagcggtgaagtgccgcggtttatccaccgtacctccagttagcaaatcctggacactgactcctttaccatcaacatcccatgcaccttcgatttggttggctgctgttgcaccaccccataaaaagttctttggaaattctgttgtcattagtttcctccttgtttacattaatttacatttatatttacataggttagtgtaaccgtttttagaaagcgctgtcaactttatttcactcttgcgtttaccacgtctttttacctctttctgtgctactatatggtagaaagacaaaactataggaatgcggtgatttatcatgaaactagctctaattggtgctgggccccgaaatttaatggctctggaacgcattttagcctggaacaaaaaggtttctgttccggaaatcgagatccatttattcgacccggcgggaattgccggccgtgtttggcaacctgatcaaccacatgaactcttgatgaattcattggcagcaaaaatcactttatttaccgatcatacgattgaaatggagggtccaagtgttcccggaccaacgttgctcgaatgggcgcggcgagcgggctctcggttcatacaagaaaacaattataaaaaatcgcagtatttactgaaagagatttctcatttaacgccagaaagttacgcaagtcgggcgctatttggtgtctatcaagaatggttttatcaagaactccacaaacaagtttcaaaaacgattcacattatttttcacaaaacggccgtgaccagtattgcccgcctaacccatcatacgtataaattgagttttgatgatgcggctgaaacttttgatggtgtttcgatggcccttggagaaggcatgtcagagctttctacttctgaaaagaacttggcccagtttgcccatgctcatcagctcacatacttaagaaccggttacccggcagagcaggactttgctaaaattccagctcacagctctgttttattgcgcggtcttggtctgaattttatggacgccatgattatgttgactcaacatcgtggcggtaaattccatcgtgaagccgacgacacgctcacctatcatgcatcgggtgaagagccaaaaatctatgctggttctggacgagggtttccttatcacgcacgtggcatggatcagaaagttgtgggtgaaacacgcccattgtactttttgtctaatcaattagttgcgcacatgattgagcatcaggaacaaatgagtggtcaacaattcctcgactatatttattccgacgcggcatgcacctactatacaaaattggtggcaaccaactataccggaataagttcccatgaatttgaacaggcgtttcaaaaggatccgttatctgcccaagttttagacgattatggcattgctaaggatgatcgcctagactggaagcacttagcgcaccctgatcaggatgtcaaaactgacaaagcatttcaaaaattaatgctggcttatttggaacatgatattgctgaggctaaacggggaaacaaaacgagtccgtttgcaagtgcaatggatactttgcgtgaactacgaacaaatatcctaaaagtcattacttataaactaatttcggatgaagactatgctaaagatattctgggtggttttaatagtttcaacagtttcttggcggtcggtcaaccaattttacgattggaacaactcctggcgttgataaaagcgggtatcgtagaaattctgggaccaaagttgcagttagaaaccaatcaggatcattttgttacgtattcaaaacggttccctgagcataaaattgagataaatgatgtgattgaggcgcgactggcatcagttgatattcgaattagtacgaacccgttgattcaagacttattaaaaactggaatggccagaccatacgaattgcatttgaatgatggctcaacgaagcagttgggagcaatggatgtgacgacggaaacggcggaagtaattgatagtgatggcgtgccggtgccaaacgtttatgtttggggaattacgacggagggacgtcattggttgacaaatggaagtccaattccaagtgtgaatgatgtgcgtttgagaatggcggatatgatagcgaaccagatgttaaattatagtgagtgaggcaaaatggtaagagagagcagataagtgtgccgtatgcggggaaatccccgcagtaggaatgcttatctgctctctcttattttgccgagctgtcctaaaacagtgagtgagaaaaagcgttaaaacaaagacctataagagaaccggaagcgggatcgcaatcccgcgggaggttttcttataggtctttgtttgctttgttgagctgtcctcaagtagtgagcggaacaagtcgcaagtactatcaaaataagctgggtgaaagtcaggagaattcctggctgggaacccagcttattttgatggtactgacttgtgaagctgtcctaaaatagtgagcggattgtggcgtttagtctcatcaatataagcgtgccgatagtgggattggaatcccacggttaggcatggttatattgatgagacggccacatggagctgtcctcaagccccaacttactgtatttggaagctaacagaatgtttttcaccatctgctgaggtaatttcgattttaattggattagttttaccctcgaaattatacgttaaatctagatcacgtatcgtttcaccttcatcgatatcgtcgtcgttttcaactgaacttaaagtttttccattttgggtcactttaacctgaccaaaattagcaaaaggtgcctttttttcagttttaggttcccactctactttcacttctacttggtcatcatctacttcagcctcaatttgatgaactgtaaatttattatatttccagctactattcagcaatgccatatcgtcatcgccaacaacagcttgacttgaactattcccacttgctttcgaactactttttgaagaagttgttacagaaaccgaagaactagtggcatcattttttgattctgaattgtcagaattattcgtacatcctcccaataaaaggaacgcggaagaaagaagcaatattgttgtttttttcatgagtttctcctttttcttagtgagttatgaatttaattttcttgctggtttgtgggcaatttttgatttaaattggtaacagctagtcaagttaggagttattcaaacaccctgccataataaaacaatccttgttgtccatcttcagcaacttcgatttttgtcacactgcaattcattggctctttaaaagccaacggatccgttgccttcactgcattttgtgcaaaacttcgcaccgtaaatccatgtgtgacaatgacaattttttggtcagtatatttttggcaaatctcatcagtaaatgctgccactcgattttctacatccgtaaatttctcgccatttgcgactttatagtactcaggataaattgcattacttcctggaatgaaatactgaccatatttagccttcaaatccgtatcatattgaccatcccagtcaccgtaagaaatttccaataaacgatcatcaacttgaattggtaaattgcgccccttattcagcaaattggccgtatcttttgctcgtgtcaatggactcacaaaaatttggtccgcaaaactaatatcaaaatgatcatgcaagttctcggcttgtttaattcccgtctcgtccaattgtgaaggctcggcatcaacctggccctgcttaaatcccataatgtttcctcgggtttcaccatgtcgcacaatgtaaagttcagtcatgttttatccccacttatctatagttattaattccatactacagctcttaagcgagaattgaaaaaccttttaaaggtttccaccccgaacttctgcgacattgtaaacaagtgcaaatgcatctggggccacggcatgaatttgattcaaaatgtgttggtactccgcattttcaaccacaatcatcagcatttgcttttgatcaccagtatacccgcccttgacatcaaaaatagtcatgcctttttccatcaaagtgactagactatgtttaacatcatctaaattgtcatcactcataatgtatattactttttttcgatccaaaccagtttcaatatagttcatgatgaacatggtcagcaccgatgaaagaatggccaaaaagaaagcttcaaacccagaaacaaatacgttgaaaaaacaaaccaagccatcaatggccaacaatccaaatgatgttttaatattaaagtactttttgaaaattagcggcggtacggtggtcccaccgctggaagcatcgatatggtataaaagcgccaccccagccgcaaagattgcgcctcctacaataacagccaacaatcgatcattcactaattttatctggggtgttaatgccaaacaaataggtaaaaacaaactaccaaacgttatgcgcagcgtggttgctttatccaaagtaaagtacgatagcaccagcattgccacatttagaatcaagacgacaagtgacatattgaaaccgaaactttcgtgcagcaaaatggcaatccctgtggttcctcctgaggcaacattgtgcggtgcgtaaaacatattaatactaatggcgataatttcgagggcaataattattaaacccatttgggataaccaatgaaattcgcgtttgttcatcacatcacctttccttccaagtaatttttcttaaattaattatctcaaatttaagcaaaaaaagctaataatgtgtataatttttaatgaatacataaacgtacaaaaaaagtagcgatagtcatctggatgattagcgttacttttattaaaaatctaaattaatgtcgatctaaaactagctcaataacttgtttacgaggtgcaaaattgatgtttatgacggtttcagtcaaaatcttttcgtactcgaccaacgcatcagccggtaagggggtgttattactcaaagaaaccaacacatcatccaccgttgtactcaaagaaatgttcatgaaaatgttgattttctcaacaacatcccttaatagatctgtcagcaagccattcggtttcccattttcatcggtaatgactaactggtgactattcaccacagtatgatcaatccgactaattcgtactacatcaaataccgatatcatttgttcgacctcacttttgcatattataacctgcattatatcccaaaagtagttgtcaaaacaagatgaacgactttaattctagccatgattgggttgtgaccacgaacggatttgaagcatccacgttaacccatatttatctgtaaacatggcaagtttagcaccccatccttggtccgccaatggcatagtgattttgactgatggttccttagccaaactagcatataagctttgcgctgccgcaagtttttcagcatcatcactatcgatgtcgatcaataaacgtgtactattggtcaatgcatcattaccctcaaaattgtctgaggcataaatccaattccctaaaatcgtaaacgccgcatgcatggtcatttgtgaaaagtcaacatttgtgggaacgttcatcgctgcagctgcttcagctgtcactggaagtctcacaatattttgggctccgaacgtacttttgtaatactcaagtgcttctttcgtatttgtgaacgttaagtaaggatagattgcgctatgtgctgtcatcgttaattcctcctcaaggaccaatcgtatttagaagtttgaacttgttgctttcattatttcaaccccgcggatagaaagcaagtaacccgctccagacgcatcaaaagttaagccttcaaattcgcgtgtattaatcttcttgttattcgcatcatatgactggaaattttctgaacggacatctcctacagatagtttgcccagttttgaaacaggtacagacaagatactgccatccgcaacaaaatataaccggtcatttaccgcattataaccaatggactgtgaatgagtgccaggtgcatgttccatgccctgcatcactaaattaatttgtaccgagttatcagacctaatactacctttataaatcttcacgccgttttttggcccccaagcggcagtattctgtacaaattcataaaagtttccatttttgtcaaaagttaaatttttgggtgtattttgattttgtcccattttaaagttgatttgtttgtctggtctcaacgtagttttgttaagctcttgaatattgcttgtctcattgctcaacccacttttcccaacaaaccaaatttggtttgtcttggggttaagtgccatcgattgcccatgaccagtcgtaaacgttggtccaaccgtcatacaagttattgcttctttttcatcatctgttaatgctttaccattcagtttattataggcagcgcgccgtaatacagaataatcttttgagtctttcactaaatcacgaagctttgtcaaattatatttgactacaaaaccttggcctgtggttgtatgtgggatttcattcattacataagcggtatccccatcgatgatcatactttgtgcgtttccaaaatcgccactttttttataagtacttggcaaatatatatccgtcgtaaaatctgtttgcccttcaccagattcatgtttaatcgtatttgctatactaacaatatgtggataatttggagctatcccataagaagagggggcgttcacaaaataatttacattttttacatacgtatattttgttttgtcaaaagcatttaaagcaacctctggctgtgtgtaggtcgatattttttttacaacttttttggtgacaattggcttttgcaacgctccaccgtaaacccagccaagatttttaccattataagacacacggaagtagtgagtcttatagactttttttgcctctcccgtaaccgtaactactttaccgtgataattcttaccatagtgcgttaacttgccttttccatagtcgccacctggcacgtggttatagaaattgttcgtagctgctaactttacctggagggtctttgcagaaagcttagtatagtatgtcgttggatcaccaagatatcccgaccagatccatcccgtatatcccgagggactcttaacttcatagtaaagttttccacctacttttgctgaacgtaataatgtaaatttgctaaaactatgtacataatatttagccttcagtatgtacttactgtgacttgctgattttaacgtgtagattctttttttattcgatttggcacggtaagtccgaataaccaccttggcagtatgactaaccgccttatttccagtaactgtgtgtgtcgcacttgcataagctggtgttgacaacgcaagtattgcaataatagtaaaaattgcctgcgaaacccttttttttaactgaatagacattttatcttctccccttatatcctcaaacaatttattttaccatgtcatataatttgtttttaccatttccacctaatagtaatcacattgaaacattagaaagcttctttacttacgaaaatatagctggtaggataaataggtaatcttattgagaggaatattcaaaatgaatacaagatatcttgatatattaaaacaacgtcgttccatttataatttaggtaaaaatgtgaccttgcccgaagcggacattaatgaattaattgaaactgcaattaaacagtcgcccacttcattcaatgctcaaacaacccgtgccgtaattttatacggtgccaaacatgatcaactctgggacattgtggccaatcgtttaaagtctgaagttcctaacgaacaagtatatgctagcacaaaacaaaaagtagccacttttaaagccgcttatgggactattttatactttactgatctcagtgttgttgctgactatgaaaagcaagtacctttgtatgccgcaaatattgctccttgggcagaacaagggattggcggcgctcaacaaaatgtttggacggcacttgccgataatcacattggtgccaatttgcaacattataatccattaattgatggcgaagttcgtcttgcatttaatattcccacaacttgggaattacgtggacaaatgccatttggctcaattgaaaagccggctgccgacaagacatttgtatcagataatgatcgatttaagattttgaaatagttacttccatttttattatttctcgatatgcttgggataactgattgtttaattactttcggttatctcttttgttttgcataattgccttctatttatcaaatgttttctttataattaataaattgaatatttttttacaaatttatgagaataacaattatactgaaacaagggtaggttatttaaaaaaataggaggagatcatgacaacattcgcgcttattttgactggattaatcggccttgagcatttaggaatcatgtttctagaaatgtttgcaggtccacacacacaagcaaatgcatttgatatgccaattacctttttgaaacaggaaaatgcccaaattgcactgagcaaccaaggtatttacaatggtgcccttggcctattaattattagttcattgttcttatttaatggcgtaacattactaacagttatgcggctgctaatgttctttattatgatcgtaggaacttacggcggcttgacagcaaccaagaaaatttttatattacagttattaccagctgctgtgacctttattttgctctttttgtaagactgttctcaaatatttgaggaatgctacagaaatctaaatagacacgcctaccgcggaataaacattccgcattcggcatgtctttctgttctctaatttagtttaggacagttcgataaagtaataaatagaatctaagttcgcctactgcggggaattatcccggcttacggcgaacttagattctatttgttaccactttatctcactcactgcacaaaaaaagaacccaagatcttctcatttcttggattcccttatgaggaagttccccaaccttttaatactgtactttttgaaataaccttacaccttcacaactttcatatttgtttcgtaagaacccgcatgacatttcatcttcgaacatctgctattcttactaattgtgcttcatcggcctttgttctagcccactcgcattatccattatctatctactggtgcgattcaagtagtctcccactgattccacacttttgtcgagccttagcgaactttttgaccgtttatccagtttatcttaccgatgttgaaaatcctccaacaaactaaggtgtttctccgttaaccgactatctctgcaacaatctcagacttcttttctacatcacgtctgtagatgatgtttttaaattttcgtttatcagattggttcaaatttaaccagctaaccttctatatgagaagaacttcttggttggggcttaaccccttcctcacttataatactaccacgatatgcaaacggttacaattaaaatgcttcccccattctttgaagtttctgccagtcctcatcagtcattgcatataccccatcgtccaccgttttaccttttaactgactattatttcgtaaaacaccctccttttgcatgccgattttctccagcactcggcccgattttttattatccacgcaatagagtgcatacatccgtttcagtcccatttcatcgaatccgagctccaaaatttgtatcgcggcttcaggagcatagccatttccccaaaacttccgcccaatcacataaccaatttcggcacttaaattatgcgtatctatatgcatttcggcgttgccaataaacttgcctgtctttttaagcacaattccccatttaccgatgggctctttgacaaaataatttaagatctcacgcttggtatcatccaaattatgatgaacttcaaacatatacttgaccgtttctggatcacttgtatactcgtacatatcttttgcatcttcaattgtcaccggacgtaaatataagcgctccgtttctaaacaattattcaacaaaagtttttcttccatgttcattacaaaacctcccgctgttgcagccaatctagtttattaaacattaaaagccaatttgaaagttgctattgattttataatcccacaaaaacaagttgtttttcattaaaattaggttaaactagatttatgacaattctagaaaaagaggcttttttatgtatacaaaacgaatccaagcactgcaaactaaattaactgacttaaaagttgatgcaatcttaattgagaaccggttcaacctgctttaactatcaggctttgatggtcttgaagatgacggtcgcttacttgtgaccactgacaacgccacgttaatcaccgacgctcgctacgaagaagatctccatgaacgcctcgaaaaaggcattgatgttgccattacccgtgattatatgaaaatcatcactagtgtggttgttaaacaacagattcacacattaggctttgaagataatcttaaatactctgattatgtaaaactgacccatttaccagaagtcaccttaaccgcaacttcgcaagtcgtcgatattctcagagctgctaaaggccctgaagaaatcgaggccaccacaaaagccattgagctttcttctcaaggctttaagtatctcctcacccaaattcacccgggcatgactgaaatccaagttgtgaacaaactggacatttggatgaaggatcatggttccactggtgcttcgtttgatacaatcgtggctagtggtccccgtgcggcaatgcctcatggagatgctactactaaagtgctcaaaacgggggaaatgattaccattgattttggctactattttgatggatacacctcagacattacccgtaccatttcactaggcgaacccgatccaaggctgaaacacatctatgaaattgtcaaagaagcccaacaaaaagtcattgatgccatcaaaccgggcgtcggtggcaaagctcttgataaaattggtcgcgattttattactgaacaaggttacggcaaagaattcaatcatggtattggtcatggcattggcttagatatccatgaatatccccaaagttacggcgcgatgcctgaatacaaggtgtctcaaaacgaaattttaaccgtggaaccgggaatttatgtggctgatcttggtggcatccggattgaagatgacgtgcttgtgaccaaggacggttgtcaacgactctcggatattacccgcgatctcattatcttaaactaattagtcgaaattaaaatgcctgttagcgaagaaatatcaactcgataattctcaccaacaggcattattttattatgaacgtttaacagcttgaaaacggctttgaagccacggtaccattcgagcgtaaatcacacctgtggcaattcccacaatcacgcctttaatcagattgaacggtaagacaccgtacaataccatattgagtgttgaaatactgatctggaaactcaccagcttaaagtagattggtaacagaatgaacagattggtcaggctcataaagaccgccattaaaactgtccccaaaatgattccccgaaccaaaaatcgggcttgctgtttaatcccttgatccatgtgtttcttcaaagaatagtaaattggtaatgcaaagcacattgtcgccaagaaattggcaataattccaatcacaccaaccatgctgctatccttagtcacaatatccaacaaacctgcaacggccgtcgtaaccgctcctgcgcctggtccatagaccaacattgtgataagaattggaacattggcaaaatcgattttcaaaaatgaaaatcctggcaaaattggaaaactaaacaataataaaacataagaaatcgcagccatcattgcgatgaccactaaacgcgtaacatttttgttacccatgtgagacatcctccttgaaggactcatcccaggtgaattatttttactcataaaaaatgaccctttatactatttcagagtatagagagccaattgaatttttagtaagctaaataacccaatcttctttatctagactttaactatcggtatcggcatttcaccgattcaaccatcgcaatgatgggtcgtggactttacaaccaccggtcgggaattacaccctgcccctgaagacgaaccttatttaattttcaagagtaatgttacactactttcaattaaataactagtaatttgtatttagaatgattttgtactaccttgcataatttcagcacccttattggttagtaagtatgaactaccatcactagtaaactgcataccttcaaattcccgtttagcactaaactgagttgactgaacatcagacttctttagttttcctaatttagaaacagggactgaaataacactatcatcggcaatcatgtacaggcgattgcgcttcttgttgtatgcaagtgactgagttcgtggaccgggagcatacagcgattaaatcgtagcacaaagaggacagatgtccttttttatttttctgattttcaaaacagacaaaaaaccggtattagttattcaccaataccagaaagtgtagacccacttttagttgctgtgtttaagcaattaaaagtcgacttttagttatcgtttttgaatggcaaacaaaattggtgggtcattttgttgattcataaattgataatttaaaacttgaaactctttttgcggtaattttgttaaaaaagtttggagatggttcagctcatctttaccacctggatgaccataataactgaccaaaatgactagtcctccccgttgcaaaatttttaggcactgttcaacagctgaaattgtggtttttgcatgtgtaataacggatttatcactaccgggtaaatagccaagattaaaaatagccgcggtaatttgggtgtcttcgggaagatgatttgataaatgttcatgtccatcgtgaattagggtagtttgatttaacaacccagttaaaagcaattgtgttttggtggcctcaagtccagcagattggacatcaaatccataaacatgcccacttttaccaacggcactggccaagtagattgtgtcgttgccgttgcccactgtggcgtcaatcacggtatcgcccggttggacaacttgatcaagtaacgtgtggctataacgtaatgcagattctagattcattttttaaacctccgtttttgttggtaaaattaaaaatcctgataataaaacgatggtggtaccaaataaaaagcccccaagaacgtcgctgggataatgaacatttaaataaatacgtgacatcccaattaaaaggatcatgctgattgcaaacaaattaactaaaccgcgttgccatttggatttgacgaggcttgcaaatatgatcatgattacgcctagaagaatgatcgtgctggtagagtggccacttgggaaactatagccaccgattgaaattagtttatgcaaagggcgaggccgttgtacaaggagtttaatagctgtatttcctaacgttcctactaaaatgctaaaagccgcaaaacttagcaggcgataatatttgacataaactagccaaccgacaagaacaagagtaaagccgatattttgcaaaggattacccaaactcgtaataaataagaaaaattgggttttagcgggtgttcgattgtgttgcataatttgcgcaattgagtgatcaaagttttgagttgcctgggtatttgcaattaccatcagcgtaactattataaagattattccggtgagtaaactggttaatagccattcgtgatgttgtttattggtttgcatgaatatctcccttattatttcagaatgcgcttctagtatatcagatttttcaaaggtttcttgcatttttatggctaatttgataggattagtccattaatgttagttgaaaagaagtagtaagtgtcagagccctttcagaaactgtgcggataatgtgagcatagattgcgaagacaccgaactcatctttttaattttattggtgaaacaagtagctggtaacgtgagttcgcgttaagaattgaagtgttcgactgactaattcaatcgtaaatataggtggtaccgcggaaaatttcgtcctataagatattttttaatatcttatgggacttttttatatagaaagggtgtagctaaattggcatataatcacgatataattgaacggaaatggcagcattactggaaagaacataaaacttttaaaacaaattcgaggacagataagccgaagtattacgcattggacatgttcccttatccttctggtcaaggactccatgtaggtcatcctgaaggctatactgccacagatatcatgtctcgattcaaacggatgcaaggatttgaagttttgcatccaatgggttgggatgcatttggcctgcctgcagagcagtatgccttaaagaccggtcataatcctcgtgagtttacagcacaaaacatcaagaacttcaaacggcaaattcgttcattaggtttttcatatgattgggatcgtgaagtcaatacgacagatcctaagttctataagtggacccaatggatttttgaacaaatgtacaaaaagggtttggcctatgaaaaagaaacacttgtgaactgggctcctgacatgatgggcggcacagttgtggccaatgaagaagttgttgatggtaaaacagagcgcggtggttatccagtttaccgtgtcccaatgaaacagtggatgctgaagattacggcttatgcagatcgtttgctggatgacttggacttaattgattggcctgaaagcatcaaggaaatgcaacgtaactggattggccgttcaactggtgccagcgtcaattttaaagttgacgggacagatgatcaaattgagatatacacaacccgtcctgatacgctgtttggcgcaagttacatggttattgccccagaacatgcattggctaaaaaactaaccacagaggctcaaaaagcggttgtggaagcctatgaaaagaagattgagactaaatctgacttggaacggaccgacctgaacaaagacaaaactggggttttcactggatcttatggaattaatcctgttaacggcgataaaataccaatttggattgcagactatgtgcttgcttcatacggaactggtgcaatcatggcggttccagctcacgatcaacgtgactgggagtttgcgaagaaatttgatttaccaattacacctgttattgaaggtggcgatgtagaggatgctccttatactgaggacggtgttcatattaattccgatttcttaaatggaatggataaacaaactgctattgataagatgattgattggcttgaagataaaggggtcggtcataaaaaagttaattatcgtttgcgagactggattttctcccgtcaacgatactggggggaaccaattcctgttatccattgggaagatggcgaaactacactagttcccgaagacgaattacctttaaaactgcctgcaactaaagatttacaaacctcagggagttacgaaagtccacttgctaacttaaaagagtgggtcaacgtggtggatgaaaacggccgtaaaggtcgccgtgaaacgaacaccatgccacagtgggcggggagctcatggtacttcttgcgttatattgatccgcataatgacgaacgaattgccgatatggatcttttgaagaaatggttgccagttgatctttacattggtggcgcggaacatgccgtcttacatttgctgtatgcgcgtttctggcacaaagtgttgtatgatctcggcgttgttccaactaaagaaccattccagaagttagtgaaccaaggaatgatcttaggtgacaaccacgaaaaaatgtcgaaatcaaagggtaatgtcattaatccagatgatattgtcaatcaatatggagccgataccttacgcttatacgaaatgttcatgggtcctttaacggagtcggtttcttggagtgaagatggcattcacggaagtgagaagtggatcgaacgggtttggcgtttaatgattgatgaaaacaatcatttgcgtgatcgggtgacaacgtttaatgatggtaaattagataaagtttataatcaaacggttaaaaaggtgacacacgattttgagcacttacatttcaatactgcaatttcacagatgatggtgtttgtgaatgaaagttataaggttgatgccttaccagtacagtacatggaaggatttgtcaaaatgctttcaccagttatgccccatgttgccgaagagttgtggcaattgttgggccatgatgacacaattacgtatgcaaaatggccaacttacgatgaagataagttagttgagtcaactgttcaagttgttctccaagtcaacggaaaagttcgttcccacatcaaagtagctaaggatacaagcaaagcagacttggaaaagattgccttggctgacgaaactctaaaagaatggatagatggtaaaacggtccgaaaagtgattgcaattcctaataaaattgtgaatgtggttgctaattaagacttagaaaagagaaaagtgaaaaaaggcgggtagattctgagcgtagccgaagttaacatatggttcgttacttgaaccgtttgttgatgtagctgagtggaagagtctgccttttttgcttacatttagatcctgaaagtttctttatattttcttacgaaatgaatttaaatttgaattgccctgtagtaatgataaaatgattaagattgagtattcgaaagtaggtcgataaattatggctgagacgcctcaagataagtcacagacaactgatgcgggatttcaaccgctaagacaaacaagtaaagaatccacttcaaaagataaaatgattgaaggctcagcctggatgacggctggtagcattttttcacgcttgttaggtgcaatctacattattccttgggtaatctggtttggcactatgagtaatcaagcgaatgccttatttgcaaagggatataatatttatagtttctttttaattgcagcgattgctgggattccatctgcgattgccaaacaagtggcacattacaatacaatcaatgaatttgcagtgggccaacggttatataaacgaggactattgttgtccggcgctaccgggattgtgtgtgcactgattttgtattttggggcaccatttctttctaatcatgatcccaatgttattccgattttgcactcacttgcctgggcagttttgattattccaacgatgagtttgactcggggtttttttcaaggctatcaggaaatggcaccatcagcaatttcacaatttgttgaacaattagcccgtgtggcctacatgttgattacggcatttctaatcatgcatgttcaccatggtaattgggtgagtgccgtttcccaatctacatttgcagcctttattggtgcgattggcgggatgttggttttagtttggtattatttccgtcaccgatctcgtttaagagaattggccgagaatagtaagcaagaactggcaatcccgactaagcagttgtataaagaaattattgctcaggcgacaccatttattattattggatctgcaattacaatttttcaattaattgaccaatatacattttttaacatcatgcaacgggcctttgactattcgacgactgtggtcaacaccttgtatgctgattttgcgtttaattctaataaactcattatgattgtggtttccttaggatctgcaatggcgattacggcggtgccaatgttatctgaggctaaaacccgcggtaataaacgagaaatcaataatcagattacggatgctttacttttgttttcgttttttatgattccttcagcacttggtatggctgccattgcccagcctttgaatacacttttttatcactatgatgttgtgggaactttagttctgcaggcatcttcatatgtgtccattattttgggactgtttacggtaatttcagcaattatgcaaggaatttccgaaaatgtccgcgcggttggttactttgcgattggcgtcgttgttaaatttgccttacaatttccactggtatcttattttggagtgatgggtcctcttctttcgacggcgattggattcggggtagtgagttggttgattctacgtcatctaaatcaagagtatggcataagtttccatcgtatcagcagaccttttgcagggatcctcgtatttagcgttttaacttttattgtggcgtatgcaactgtccacttgagctatttagcattgaaccctaatagtaaatttatggctgttttcgtatcggttttggcagcctgcttaggtggaattgtttatttatatgcgactttaaaaacgagattagcggatatgatgattggcgatcgggttgaacggattcgaagaatattacggatccattaaggagcgcgttatgcgaattgataagtttttgcaccagatgaatattggaacacgaagtcaggttacccagttaattaaaaagggtacagttaccttaaacgcacgcagagtactcactggcaaaacgcaattaaatccaggtcaagatctggtaaaattgggtgaacgtgagattcaatatcaagttcattattattatttgctcaacaaacctttgggtgtcatttctgcgtcaacggataaccatcaaaaaacagtaatggatttgtttaataagtctgattaccgttctgacctttttccagttggcagacttgataaggatacggagggactcctacttattaccaatgatggcgatttagcacacaagctgttatcaccagcccatcatgttaagaaagtttatgaagcgacagtaactggtaaacttgatgatcaagtcattgaaaaatttgctaaggggattacgttaaaggatgggactgagttatatccagccaaacttgaaatcctaaattataacaaacttgaagatacgactaaagttcacgttcaaattcaggaaggcaaatatcaccaggtacggcgaatgtttggcgcgatgggtggaaaggttgtacatcttcagcgaattcaaatggggaccttggctattgatgttggtttgttgccaggtaattatcgtgaattaagtcaagatgaggtcgatgacttattggctttaactaaataaaaacgaaaagaggccgcgcaaaaacataggttttgcgcggcctctttctacttctcgaatattattgggctactaaaacgtgaaaaaaagacagatttcaggatatgcttaagatctaatcgtttttttactctcgttttgaaaattttgccattgcttgcggaatttggttgataatctgatgcggtaaggtaacatactgcgttttacctaattcatcggcaatataactgtgcaaataggttgcactgagaattgcttgaatttcgtgatctgaaaactgaacaacaaagccaccaatcatgccggctaatgtgtcgcccatcccgccagttgccatttcaggaccacccagttttaattggtaaacagtatcattggtataaatttcagtgtgatacttttttaaaacaacggtggcttgtaatttttgttgggcttttcgatttttggtttcggtttgttcagcaatcggaatgccagacagtcgttgccattccatctcgtgaggtgtaaagacgatcttggcatctgggagggataagtggtgggcagctactagatcgatcgcagaaccgtcaataatcaaatgttgagtagattgaatggactgaaagacagcctgcacaacttggagagccaatttgtcttcacctaaaccagggccgatgacaatgccgtcgactgttttgattaattttttaagttccgtatcattttgaaaatcgatcaccattgtttctggaaggcgagcgtgcagactagcaaagttggtggaatgagtagcagtggttaccaaaccagtaccagaatagactgcggcactactagttaagataatcgcaccaccaaattgagcattaccaccaatgactaataatcgtccaaatgaacctttgtgcgtgtgagtggctcgtttttttatggtttctgtaaccattgattgcgtaattgttttcataaaattagtcctccctaaagttagtataacgaaaaaaatacgatagtaaaatcagaagggccttttactataagaattcataagcgtttgctacaatgaaaatagataaactagaaagcgagatgagtaccatgcaaaatcaacaatatcaaaatattttagtcggaatcgatggttctgaaacttcaatgagagcactagataaggcaattgatgccgcaattcgaaaccaagccaaactatatatcgcgcaagttttaaaaccccaattatcaactgtaggaagggcatctatggggtttggcgtcgttgaaacagatatagatgatgaaagtcgtctgaaagagcaaaagcaacttttagatgacgtggtagctcaagcaaaggacaagggtgttaaagatgtcacgagcattgtcaagattggcaatccacgagaagagttggctcgtaatattcaacaagcacaaaagatcgatttaatttacattggggcaacaggtgcaaatcgggtggcgcaaatgtttttaggatcgaacacaacttatattctagagaattctattgcggacgttatggtggttagataaaaaattgccaaacttgaattaagtaaggtatagcgaaatagctatttaggatcggtaaatgactgttccgctattcgtttactcaaaaaaagagaaacacggcattaactattaaaataagtaaggaggcatactgagggaaatctaaggaccttagtagactaacagatgaaaacattaattgtgcttgaaaatgtggtaatggatggtgtgaaacgtgcggcaactgttttggggaatgctctgactaaatatgcagatgtgacttattattcattagaaaacgtcacgccttattacgaattaaaagccaaactggttgtggcaaaacgaccagcctccggacacgttcttaatttttttggtgaaaaaccttatgaaaattatcgtgatcagatcgatgatttaagtgaatttattgaacagggtggtttccaaagcgttattttagctgccggattgaccacaagttttggtccgttaattaaaaaaagaattccaaatgttcgaattgtggcctggatgcacaacaactataagacttatctgactcaatattatcaacgaatggaaaaagaatttgtggctggtttgaaacaagcggatgcagttgttgttttaacagattcagatttaaaaaattatcgtcagtttaatccgaatactgtcaaaatatacaatccgctaactttgaatccagataaaaaagccgatttaacttctcatacaattgcatttacagcacgaattgcgattccacataaaggaattgatttattattggaggctgctcagtatttgccagatgattggaagatcgccattgccggacaaggagtgccagagcagatggctttattcagacaactagttgaaaaatttgatgtggcagataaaattatctatcggggcgcgctgaaagataagacgttacaggaacactatgaaacggcatcaatttttgtatccacttcgcggtgggaagggatgccacttgtgattggtgaggccatgggatttggtttgccaattgtcgccatggaaaacacgggatctgcagagtttcttggtcacaatcaatatggcgtgttaacgaaacctgaggacgtgatggactttgtcaaagaacttaataaagtcataatcagtgagccgttgcggcatatttattctaagaaatcattagaacgtattcaggcgtttaagattgaaacgattattaaacagtggttaccgcttttaggcagtaattctgctggtttatctaaggcgttttaaaaataatttttaaatatgtaaattaacattgaaaacgacttcaattttcgatatggtaaggttagtaaataagaaagtcgatgatcataagtgtataaattaatcgttagcgatttggatgaaacgttacttggtagcgatggaaaaatctctcaagaaaatatcgaggctattaaagcagcctccaaaaagggagttaagttcgtgcccaatacgggccgaggttttgcttcagtgcaagttttattgcaaaaattaggtctctatcaagaggctaatgaatttgtgatttcttataatggtggcgcaattgttgagaaccaggataatagggttcttcaaacaaatgaaatgacgtatgaagaagccaaaggtgtttttgaaattacttctcaatatctgcacaatgatacccatgtgtatacgttaaaccaattgtatatctataatccccgtgaagaggatctggcttacttgaaaccacggcatgtgaactatcacatcatggaaaatgatgatttttcaatttttaaagatgataaaattatgaaagtcattaccatgaatcctgaccaagaggttttgcggccagttcatgataaggtgatggatacttttgataaccagttgaatgccagctattcttccgggatgtatgctgagtttaatcatttaggcactgacaaaggaacggcaaccttggagcttgctgactctttaggaatcaaaaaagacgaaattttggcgcttggtgacaatagtaatgatcttcctatgttacgtaaagtgggaatgcctgttgttgtggcaaatggaactactgaggcaaagagtttagctaaatatgtgactaagaataattatcaaactggggttgccgaggcaattgaaaagtttgtgttataaatccatattagtttaggtcatggaggaacaagatgttaaaagcagcattagtgggtgtccctggtttaattgcaattatgctagtggtaatcacattgtatgtacaactgcccttctggcttttaatcgtgctgtgggcagttggatttgttgctgccattattttggtcacggtgtttgaactcaaaatcaaattagcagccatgaaacgggatgcagaagaagcagtcaaaaaagaacaatctgagaaataaagagggattattatgttcatgtctacggaagaaatcaacgtgggtcatacaattgtggggatcgtttctgccacaagccggattatgttatcggctgatgaaattgaccagtatcaaatgtttgaccaacttattgaagaaactaaaaataaattaagtaaacgggctgaacttaaagacggggacggtttaattggggtacattttaacacagaagttgtgaatgtgagtgtggcgccaaagtttttgattgtagtgggctacggtaccgtggttaaactagataagtgagtattatctgaagaataatctttttgacagtaagtggcgcacaagtttaatagagcttttcattcttttgaatatagtgtaaaatgattactgttgtttagccccagtggcggaactggcagacgcgcagcgttcaggtcgctgtatgggcaaccatgtacaggttcgaatcctgcctggggcattttagtacaatataggaactttttagaaatcaggaatggctttataccggcattcctgatttttcgttatcacaagaaagcactagaaaacactaacaagtaaatacattttgcacaaattttgcacagctaggaaatctttgacgccttatctgatgcctttttaacagttaatttatttaattctttttctattttttgatcagatcgtgctttaaactcatcaatcagatatgcatatattttcgatgtagttgatagatcagaatggcctaaccgtttagagatcacatacagatctattccagaggctaataagaaggccacatgagtatgtcttaacgaatgaaagtgaaagcccgttttaactattttaaggtcgctaagggctttttgagtgttttgttgcacgctgccgaagtggggcataatttactatttactagttttaatctattttcaaaattgctacaaattctataaaatcagctctttccttggtaatgacagggacggagctgtttttgctttggaacagattaagaatttgttttttgtaacggggaaaacagttttataaaaagcaacttggaacaaagggtgcgttcaaattcataaaaaatagggaagtttgaaattaggtctaaattttggcatctgaatatggtatgcttattggtgcactttttgattttgaaattttgaataaatgcggttaattaataaaagttgaaatcaatatactttaatttatttgagaaatagcgtaaggaaaacgtttaagcttgtttaaagacgacagcataatttaaaatgaaacgcaatatgttgtagaccaattaattatgatatactaaatattgattatagataaaagaggggccttgtatggtgataattacagcaggaatgattggtgttgggaaaacaacgttaactggaaagattgcaaagcattatggttcaaaagctttttacgaaccagttggtgataatccagtattgccattatattattctgatcaaaaaagttatggatttttactgcaaatttattttttaaataaacgatttgcaatgataaaaaaagcactttctgatgataataatgttttggatcgctcaatttatgaagatgcattgtttactcgtgaaaataataaagaaggtaacattacagataccgaatttggtgtttatttgaatcttctggataatatgatgaatgagttgaatgaccttcctaagaaagcaccagacttgatggtgtatgcggaaaccgattttgatacgattttatatcgtattaaaaagcggggtcgtgactatgaacaattcgacaataatcctgaacttgaggactattatcttaagatgtgggcagcgtataaagaatggtatcgtgattacgatgcaagtcctaagctcaaaattgatttacaaaagtacgatttagagaatccaaaaaatgttgaaactgtactgggtcaaattgatacagctttagcgaagattcgcgaaccaaaagatgttgaagaagcaatgtaaaaaaactattcacgtggaatgcaaaggcacttcacatgaatagtttttttgtggaattaattattcttttgttgcgcaattaatgcttttagactagcgttatctcgatgggcaagtaaggcccaaagaatcgtgacggtatcgacaacttcttgaaatagcgcgccaagcaaggcagggatgataccagtggcagcgacgagcatcagaccaatacagataaaaatgccaattaaaacggattgtttcgcgattttcatagtatattgagaaatgctcaaagcacgcgcaactcgacctaaatcatcttttaggatcacaatgtcggccgattcactggcagcggttgaaccacgcgcgcccattgcaattccaacatcagcgacggttaatgatggcgcatcattgacgccatcacctaccataacaaccggacggagatgattttcttgatccttcaaaaccgcaattttgtctttaggtaaacactcagaataaacttttgcgattccaatttggttaccgaccatttcagcagtagctttttggtcgccactaatcattaaggtgtttttgatgcccaattcatttaactgcgagattgtaatttgtgcttcagggcgaatttgatcagaaaaagtaatgtaacctgcaaatttatcgttgatggaaacaaagattgcagtttgtttagataacggcttaatttctcgagttgcaaatttttgacggccaattttgatctgttggtgatcaacttgagccgtaatacccatgccggtaacttcttgaatgtctgaaactggcaaaagtgttttagaatcaacagcatttacaatggaacgggccaagatatggcttgattgttgttcagcactagctgcaaggcttaataattgttcatttgtgtaaggtggcaaacttttaatttgatcgatggctaaaattcccttcgtcagcgttcctgttttatcgaaggcaattgttttggcagtggcaaatttttcaattgttgtaccatttttaatgataattccatttcggttcgcactactcattccagatacaagcgcaattggtgccgccaaaatcagtggacatggggaagccacaacgagaacttctgcaaagcgaacaggatcttttgaaatataccaagcaattccggcaatgagataagaaacaattgtaaatggaatggcgtatcgatccgctaaacgaacaaagtgagcaggttgtgcctcggaagctttgaccagtttaacaattgtttgatactgactatcggcggctatttttgtgactttcatcgtaatggcgccatccccattgatggatccggacatcaggtcatcattaagcgatttagatactggattagattcaccagttaatgaagattcatcaaaaattgaagagccggatagcacaatcccatcaacaggtacgacttcgccaggtttgaccacaacttggtcaccaatttgaacagcatcaaccggtttggtggtaattttgccatctaagagcacatgggcattttgtggagaattgtcgagcagattttgaagttctttgcctgccttatgggcggcataatcttctaaggaatccccgccagtcagcataatgagcactacgatacttgcccaatattccccaacagctaaggtagcaatgatagccgtgatcgccaacagatctattccatatttgccagcacgcaaggtcttaatcatttcaattaacatggagatcgaaatcaggattcctaccacagtgataataatttgagcaactaaattgagatggaaaacaaactctaggaaaagtgctaaaaccccaagaaggacaactaaggcaaatttagtagtatgtttcatacccagcaacttctttcttatttagaatgattctaaaaccattataaatgaaatctagtcaaattaccagtagaatgaagaattatttgggcttattcatccttagcatgaagaccggaatgattagcaatagatgaataataaacatgcccaagaaggtccagctatagtcaaaatccgtaataaaatagccaccaaataaagtaccaagtgcgcgacccatggatccggcaaaactccctacagattggatggtgcctcgattacgatcatcagcaaaccggtttaataaagccgggattgcgatgagggccaacatttcaccaaaagtgactaaggtaatgcctaaaacataacgccagtagcttccagtattaataattgccaaataagaaagggcaaacgaaattaatcctaaaataatgcgcattttttcggccttaaaactgggtttgaataaacgagtggtaaatggttgaattaaaataatttctacagtactgattgtaaaaaggagactatacttaggaacagagatgtgtttagcaaccatcagtaccgaaacattactattccactgttcatagcagatccaaattatgaccatgaccaaacaaataatgagaatacttcctagagcgtgtcgagaaccgttatcagttgtaccttgattagtggttactggatgttttttgatagttttaaatgacagtctaatcagcaatgttgttaacaaaaataagacagtagaactaaaaaagaccatgcggatactaatcccaaataaaattcctgacataaaggtagcaaatcccatgcctaagctagcgaaccagtaaccgttattaaaaatgttaggatcttggacttgaaggaaggcaatgtaaccattaatggcggaatttaggccacctaaaaacaggccgtatagcgtgattaagaccggataaatcggccattgtgggaaaagccctagtagaaataaagcagtcacaacgccaattccgttcacatacatgagtggtttttgccgccaactatcaaagagcttgccgccaatcaggttgccaatcatcatagctcctgaaaaacaaaaaagcacgtaacctgcagttactaagcttttgtttaaagtcctatgaatgtaaagggtggtgatcggcataatcagaccaatacccatattgaccaacatgtttgtaaataaaaccggtttatttttcataggaaataacgcctttctgtggagctcataattttctaattaaatgttaatcatactattacataaggattagcaaatttcaacgattttcaagaactgctgacaataaaaatggaaaatcaagataagattaaagacggatggcaattattgagttttcactgctggtagtattctagtgctaaatttggtaaaatatttttgttacggtaatttattaattgaggatcaagtcgttaaattatcaatcaaataactaatataactaagaaaaaaaagggagtctataaaatgtgtggatttgtggggtatctcaaccaaactgatgtcaattctgatgtcattaaatcaatggcggaccggattaaacatcgtggtccagatgatgaggcttattttcaagacgaagatgcttctttaggttttagacgtctctcaattattgatttggcacatggtaaacaaccaatgctgaactcaacgaaaaccaaagttttaacttttaatggtgaaatttacaattataaagagattcgtgaagaattaaaaaaattaggatataattttcaaactgatgtagattccgaagtgttgatccatggctatgatgcatggggggcagaccttttacaaaagcttcgcggaatgtacgcttttgtgatttatgatacgcagaaaaaagaagtgtttggtgcgcgggatcattttggaattaaaccgctttactattatgatgatggtgaatccttcctttggggatcagaaatcaaagcctttttggagcatccaaagttccacaaagaattcaatgaaaaattgctaccaattcatttaagttttgaattcattccttcaaaagaaacaatgttcaagaatgtgtacaaacttttacctggaacatatttcttgcacaaagacggcaaaactgaaacccatacgtactttaaatttaattatgatcatattgacgaatcacaaaccattgaaggtgatgccaagaagatccgcggaattgtcaaggattctgtgaaggctcatatgattgcggatgtggaagttggtagtttcttatcaagtgggatcgattcaagctatgtcttggctgaagcagctaaattaaagccaattcagtcattttcacttgggtttaataattcaaagtacagtgaattaagttattcgactgaatttgcaaaagaaattcatcaacaaaacacacctttaacgatggatggtgacgactattttgatattttgccaaccattatgtattacatggatgaaccattgtccaatccttcagcaatgcagctttattacttgtctaaagggacaagggaacatgtgaaggttgccttgtcaggtgagggtgccgacgaattctttggtgggtataacacttatttagaagcatttccatttgaacgttatcaaaaatgggtacctcagtttgtgcgtacaggtcttgctaaactggttcaaaatctgccaagattccatggcaaacgtttcttagttcgaggtgcagagccattaagtgaacgttattaccgagttaattatgtttttgacaaacatgaacgggatgaaatcttacgtgatcctagtataaatgtggattctggtgcttacaccaaacatatttttgatgaggtcaagggcaaagatgaaatgactcaaatgcaatattttgatatcaatacttggctaccatttgatatcttgcataaggcagatcggatgagtatgtgtaattccttggaagttcgcacaccattagttgataaagaagtggctaagtttgcggcaacgatgccaattaaaactcgaattcataaagaagagacaaagatttctttgcgaacggctgctgaaagtgaacttccagaacgagtagcgaagaaagagaagatgggtttcccatccccaattgcgagttggattaaagaagacaagtatcgtaaacggattgaaacagcctttaactctgatgttgccaaacgttttttcaaaccagaggctttaatgcatattctgcatgaacatattaatggcaaatcaagtatgcaaaagatttttacaatttacacctttattttgtggtatgaagtttatttcccagaaaatactacagccacaacaagtaagttagttcgtcgcacacaagtttaatatttggagatggaaaatatggcactcgagattgccgaaattaccatgattttaaaagaacatcatttactgaaacaaatagtaaataatgttaaaggcgatcatcaaaaaataacgggggttaaatatgactctcgtcatgcagttgccaatgaccttttcttttgtaagggtaattttaaaccagattatctaaaagtcgcacaggataaaggcgcgacggtttacattgcagaacagcaatttgaagaagttccaatgatgtgtggcattattgtaaccgacgtgaccaaagcgatggcgttaataggggcagctttttatgattatccgcaaaatgatttgtttatcattgctttcacaggcacaaaaggtaaaacaacttcggcttattttacgcaccatattttaaaaaccatttcggaaaataaagctgccttattttcaaccattgatcgtataacgggacctaaaccagaacaagaatttaaatctgatttaacaacgcctgaatcgttaaatttatttcacgatatgcgagaagctgtcaataatggcatgcattcgcttgttatggaagtttcctcacaggcttatttacgaaatcgggtatatggtctacattatgacgtaggagtattcctgaatattacgcctgaccatattggccgtaatgaacatccgacatttgaaaattatttgcattgtaaaatgcaattgatggttaattcggatgtttgtgtgattaatgcacaaactgctcatcttgaagaaatttatcaggctgctcgtgcaacgacagatccagaaaaaatttatttatttaagcaggcaaatgctaaaattaatcgcgcagttcctattgatgttgttttttataatgatcgtgatgatttgcgattgaccgagattgaagtcaaagcagtaagtccaagagcaaaagctttaaagattgatggtcgttatgatttgagtatgcctggtgactataatcaaagcaacgccacaagtgccttgattgctgccggattagctggtgcgacttatgatcaaacgcacaacttgttaacaaagatgaaagtcccgggccgaatggaatccgtggtttcgaaaaatcacggggtcatctatgttgattatgcccataattatgccagcatgaatgcccttttgagctttttaaaaagtcagtatccaaaaggacgtatgattgtggttgtgggtagtccaggagacaagggaatttctcggcgaaagggctttggcgaggcgctcactgctcatgcagatgttgcaattttaacgacggacgatccagggtttgaagagccaagtgcaatcattgatgtgattgacagctacattgatcatacaaaagtgcaggttgaaaaagttattgatcgttattctgcaattaaacgggcaatttcaattagtcgtccagaggatgttgttgtcttagcagctaaaggagaggacccatatcaaaaagtcagaggagttgatactccttggccaacagatatgaaagttgcaaaagaagttttgaaaggattggcgtaatggaaaactcaaaaaatgattatataccagtgctattaggtagtgattttaatgcatatggaatggcgcgttcattttataaaatgactggcaaaaaggtcaaagcatttgcagaaaaagaattagctccaacccgattcacaaaaatcgtggatttggagttgattcctggtttttcagaggatcccgttttctttgaaacgatgaagaagattgccaagcgttatgaaaatcgttctgaaaaggtgattttgcttggaatgggtgatggatatgccgaattaatttcaaaacacaaagaagaactttctaaaaccttcatttgcccatatgttgattatgatttgctacgtcaattaaacaacaaagaacgtttttataaaatttgtgatgagtttgatttaccatatcctaagactagaatcattactaaagatgaatatgaaagttctgaagaaattgaagaaccatttggttatccagtcgctttaaaacctgccaacagtgtggaatggcttgatattcattttgagggtcgaaaaaaggcctttcgtattcaatcacgtgcggagtttgatgaaattgttgggaagatttacgacaatggctatacttccgatttgattttacaggattttgtccctggtgatgacagtaacatgcgtgtcttgaatgcctatgtggatcagtatcatcacgttaaaatgatgtgtttgggtcatcctctattagaagatgttgcaccatctgctatcggcaattatgtggcaattttacctgaatacaattcgacgatttataagacgatccaatatttcttagaaaagatcaattttaccggttatgctaattttgatttgaagtatgattctcgtgataagacctataaactatttgaaattaacttacgccaaggacgaagcagtttctttgtgacgttgaatggttataatcttgctcagtgggttgtgcaagattatgtgagcgaagatttgaagaataagccgactgtctatgctaaccgatctgaggatacccatcagttatggttaggcgtgccaattcgggtgttcaaaaaatatgcccgtgataaccgagataaattaaccgccttacaacttatcaagcaaaaacgatatgggatgacagcttttgataaaaaagatatgaatcctaagcgatttgcgttattgacttggatgaatcacaactatgctaaaaattttgatcgttattttgaagaaaacaagggatgagttaaatgaaagatttctttacaattattggtggtatggggacaccggcaacggaaagttatttgcggttgttaaacaaacgaacacccgctcatcaagaccaagattactttaattatattttagtaaaccatgccacagttccagatcgttccacatatctgatggaccattctcaaccaagtccattacctgatctgttggcggatattaaggaacaaagtcaattaaaacctagtttttttgtgattgcctgcaatactgctcattacttttatgatgatttacaagcggcaacacctgtaccaattgtgcatatgccacgagaaactgtaagttacatcaaaaagaattatccagatgctaagcgaattggggttattggaacaaaaggaaccacgactgatggcatttatgatcgggaactaattcaacagaatttagaagttgtgaaaccaactgatcaaattcaaaagctaacgactgaattaatttttgatgatattaaaaaccaaaatcaggttgatggtgagcttttccatgaaattgtgaaacgaatggttcaagagcaaggtgctgaggttgttattctaggttgtacggaattatcttacgcgcaagaactggctcctgaactgaaatttccagttgctgattctcaatcaatcttggttgataagtcaattgaattagcaacaaagttaagagcaaaataattatgatagagtaggttagtaagtgactagttagatgaaaacattcatgacaaaaattggtcaatatgctatacttacttttgtgtttgcgggcatagtttagtggtaaaattcaagcttcccaagcttgcgtcgcgggtccgattcccgttgcccgcttttccgtaagagagtagtacctaattcattttcttttagcgagttcggaatggtggaagccgaatagaaaaagttagtgaacgtgcttttatgtttataatttaagaaattgagtggattttaaaatcaattagagtggtaccgcgggttttctcgtctcttacaaagtttatttgtaagagacttttttaatttgaatttataaatggaggaactaaagatgaattacaagaaacaagtggcacaaagtattgtagatgccttagataatcagttagatgagcaggtagtttacgaaaagattgaagtaccaaaggcgacaaatcttggagattatgcttttccaacgtttgtgttggctaagactttgcacaaggccccacaaatgatcgcaaaggatttagtggaacaaatcaataaatctggttatgaaaaagttgaagcacaaggaccttatgtgaacttcttcttagataaaggtacgttcagtaatgaagttttacaaaccgttttaacgcaaaatagccactatggggatgccacaatcggtaataacggtaaagtgccaatcgatatgtcttcgcctaacattgctaaaccaatttcaatgggtcatttgcgatcaactgtaattggtaattctttggccaatttgctatccaaaacgggttaccaacccgttaaaattaatcatttaggcgattgggggacccaatttggtaagcttattgaagcctacaaactctggggaagtgaagaagaagttaaagctgatccaatcaataaattacttgaatattacgtgcgttttcataaagaagaccaggaacaccctgaactagatgatgaagcgcgcaaatggtttaaaaagcttgaggatggcgacaaagaagccactgaactttggcaatggttccgttctgtttcattgaaatcatttaaacggatctacgataagttaggaattacgtttgattcctataagggtgaagctttttataatgataaaatggatgaagttgttcaactcttagaggataagaacctcttaaaagaaagtcaaggagcagaaattgttgaccttgataaatataatttgaatccggcgctaattaagaagacagatggcgcaactctgtatattacccgtgatttggcagctgctatttatcgaaaacggacttatgactttgtacaatctttatatgtcgttggtgcagagcagattaatcactttaaacagttgaaagctgttttaaaagaaatgggctttgattggtcagataatatccaccacattccgtttggtttaatcacgttgaatggtaagaagctgtcaactcgttctggtcgagttgtcttactagataaagttttagatgatgccatcgatttagctaaacaacaaattcaatctaagaaccctgatttgaaggatgctgataaggtcgcgcatgaagttggggtaggagctgtcatcttccatgatttgaaaaatgagcgtatgaactcgtttgattttgatttgagcgaagttgttcgttttgaaggcgaaactggtccttatgtgcaatacacaagagcacgtgcggaaagtattttaagaaagtcggatcataaagtgaaaattaccgacttgaacttagcagatcctaatgcttgggaaacattgaagttcttgcaagcatttccagagactattttacgggcagtaaaggaatatgaaccttcagttattgctaaatatgcgctacatttagctaaatctttcaaccaatactatgccaattcaaaagtgttagttgaagacgacgatttaaatgcgcgccttgcacttgttcaaagtgtcagtgttgtgctagaaattgctttgagccttttgggtgtccaagcaccatcagaaatgtaatttacaaaaaatcgtaagttaggtaaaagtgaggatattgatcatgttttacctaatgaaattcataaaaaagaagaggttggggaaaaagtttcctcaacctcttaaatataggccaaaatagccgaaaatgagaagaatttctcatttcaaaagtagggaatctcgaagcatgcaaaattaagacctgatacaatagatatgttgaggtattaattgagtcgaattatatttgaggaggaaacaaagatggaaatcaaaggctttggtgtcgaagaatggctaaacaaaaatgaaaaagcggctcaatttgatatctcgcagagcacaattagttcactaactttgggggaattacttagttttgatagccaggatccgacagcgacatttactaaatatttaaacactaaattaaattatggttggatcgaaggatcaccagaatttaaaaaattagttgcgcaactatacgaccaggttgatagtcaaaatattttacagacaaatggtgctaccggtggaaactttttggcactcttcagtttattgaatcccggagatcacatcatttccttatatcccagttaccagcaactgtatgacttgcccaagtctttgggcgtgaaagttgatgagtgggatttaaaagagagtttaaattggcaacctgatttggctcaattacgacagcttatttcgccaaaaaccaagatgatttgtttaaataatgctcaaaatccaactggcagcctcctcaataaggcgttgttggagcaggtcgttttgttggctagaaaagttggcgcttatgtcttagctgatgaagtctatcagccggtggataaaattgatgaatttccagatatcgctgatttatatgaaaagggaatttctgtaaatagcctttcaaaaacgtattctgttcctggattacgaattggttggattgcaactcagtctaaagaacttgccgacatatttagaaaatatcgggattatacaatgatttcaggcggtgtggttaatgatacattggcttgtatgacattgcgaaaccgaaaggccattttacagcgtaacggaaaattagtacaaagaaatcataaaattttagagcagtgggtcaagaatcaacccaaagtagaaataattatgccagaacaagtttcaacagcctgtgtcaaactaaatattcaaatgtatgatgaagaattctgcgaagagttgttgcaaaagactggcgtattaattgttcctggatctagattcgatatgccagggcatgctcgtattggctactgtacagatacagaaacgttaaagattggattgaaaaaattaggtgatttcttaaatcagtgtgagtaaaaatcacgtcaaactattttaagaataattcttggcttttatatctgtttctgggataatagatacattatatttttttgaaaagaggctaactatatgattaaccccaagcaacaaagaatttttgagcgtcatctagcacatgtcccaggaagtcatattcttaaagcttccgaatataaaaaggtggtaagttgtctgcattataagaagattgccaagggtcagaatttggttgatcagcacgatgatcgaaattacacgtttatattaaaaaagggttttttaaaaatcagatcattcgatgccaaagaggacgcgtcctacgtgagctttctcagtcccaatatgctgtttccgttacgggggatgtttgttgacagtcgttattgttatacagttacagcgttgactaacgcagaagtcatttttatcccaacaaaaacgtttgagggcttgctgaaaagtaatcacaaattttcattaatgattattaaaaagatgcaagaggtcgtttcagaagaggagatttttattcagagggcgttgactccatctgcaacaaaaagagtggagcaggtattaaagtacttgaataatcatcatggtatagaattggaaggcggcagacaaatcccgtttccgttaacaattaaagaaattgccacaattgcgggcactacccgggaaacagctggccaagttattcacgaattagttgatgaaactgagctggagtattcacgtaaatatcttttctttccagaaatctataccgaagaagcctagactgttatgtgtttttgaattttggtatacttgagaaagttaatacggaagtgaagtgcagttatgaaaaaaagtgaacgtcaaaagatcattaaagaccttattgcaaatcaactagttgcgaagcaagatgatttgatgaccttgttgaaaactcatcaagttgtggcaacgcaggctactatttctcgtgatatgcgcgaaatgcatattgtaaagggaaccgatcatgaaggtcatcaaaggtatatgatttttgaaaccaatgatgaagatccagcagaagctctttttaaaacctttaagcaaacggcacaacaaattgatcaaattcagtttgttaatattattaaaacaacaccaaatgatggtaatcgattggcagctgtttttgatgatacacagatgccagaaatcgttggaactttagcgggatttgatacgattgtggtttttagtcccgatgaagcattagcaactcaattacatcaaaagttagctcattatttatctgctgaaggctaataagaatacagagtaaaaccagaagctttgacgacggctcaattatcgttaaaatctagttttgctctgtttttgtggtttcaaaaagaaaaatttttcggccgctttttaagggtcttttaaaattcgatgaggatttaaaaggggttcttaaactgtgatacaatacagctaacattctatttaaacggagacttttatgaaaactaataatttcctttcttcggttttaacggtaattaaacgaattggtcattttttagcgccatattggcgtcaatttagagtcctttttggtcgttactggcgaagatttcaattaacgcgatggttgattattttgttcttaagcttttttttggtgatgagtggttatctgacttaccgggccaaaacggctaatgttgctgacctaaagacagaattagaaaaaccaacggtcgtatatgatgcaaaaaataaaaaagccggctccttgtattctcaaaagggaacttgggtcagcttaagcaagatgtcaatcaatgtgcaaaatgcagtaatatcaactgaagatagaggcttttataaagagtatggtttctctgttaaaggaattggtagggcggcattgttgtatgcagtgaataaagtattaaggcggaattatataagtggtggtggtagtacgttaactcaacagctggttaaaaacgctctattatcacaacaacagacctttacgcgcaaggcaaaagaactgtttttgtcgattgaagtcgaaaatgtatacactaaatcagaaattttagaaatgtacttgaataatgcttactttgggaacggtgtctggggtgttcaagatgcttctaaacgctattttggggtttctgcaagtcaattaacagtcccccaagcagctgttttagcggggatattgaagtcacctagtgcatataatccggccgatcaccccgcggcttcaaaacaacgacggaatgtcgttttaagcttgatggccgaaaataaaaaaataacgacttctcaagcaaaaacgtatgaaagaacggctttaacaaccgcgaatactttttcagataccagtggctataagtatccgtattactttgatgccgtaatcaacgaggcaattagtcgctatggtttgactgaatctgatatcatgaatcgtggctacaaaatttacacgtacttgaatcagagcgatcaaacaagtatgcaggaaaaattcaagaattctagttattttcctgcgaatgcatcggatgggacaaaagtacaagcggcttcaattgcgatcaaccctaaaacggggggagtggccgctgtagtcggcggacgtggcaagcacgttttcaggggctttaatcgtgcaacccagatgaaacgtcaacctggatcaacattgaagccgattgccgtttatgcaccagcattgtctagcggatattcctacgattctactttgacggacaagttacaatcctacgggacaaacaagtatcgcccagaaaattataacaatgagtatgtgggttcgttgccaatgtataaggcgttggcggagagtcgtaatgccccagcagtctggttacttaataagattggtgtggctaaagggtatgcgtctgttcaaaaatttggtttgaatattgataaaagtgataagaacttggcattagctcttggtggattaacgacaggtatttcgccttaccagttggcaagtgcttacacggcttttgcgaataatggtgaactggcgcaaaccggttttattcgaaagattgtggattcttctggaaagactattgtgaataatacgacacaaaccaaacgtgtgatttccaaaaaagtggctaaagaaatgacaagtatgatgataggtgtttatagtgattcatatgggactggcgtgaatgcgaaacctgctgggtacacaattgccggtaagaccggtagtactgaggtagatggtgcctcaactagcgacgcaaccactgatgaatggatgattggctatacgccagatatggtggtagccacatgggaaggctttgacgataccaccaaaacgaaccatttggaaaacctaagtggagttggtttaagctccttgtttaaggcggagatggaaggcattttaccaaatactgctggcacgagtttcaataccaccaatgcgtctactttagctaccgcggaaagttccagttcaggttctagtatttgggacagtattcaaaatggtacttctagcgcagaaaaaagcttttcaaaaggaacagaatcctttaagcaaaaggcaagtgaatgggttgataaagccaagaattttcttggtggtaattaaactttattgaatgcgcgtatcaaaccggctttggtatgatacaatatcagtataaaagcgtaaacatctaggaggaagacaatggctgttaatatttacgatactgcaaacaaaatggaagaagaaattcgccaaacaactgagtatacgagtttgagtgcagcatatgcagaaatgaagaaagatcctaaggcatatgaactttttaaagattttcaagaagttcaagttaatttgcagcaaaaacagatgaatggtgaagatctaactgacgatgagatgaagcatgcacgcgaagttgcgagtcaagttggcaacgtggatgtcattaaggcgttgatggacaaagaacgcaatttgaaccaacttttaaatgatatcaatcaaattattactaaaccgatacaagaattgtatcaaaattaagatgaataacgcttcaaaaagcgtattttaaatacaaacagggttagtgcaaatgatgatttgttctggcccttttttatgaatcaaggagttaaactatgaaatttattcattcagcagatattcatttggatagtccgtttaaaggattacgaaaagcaccagatcaagtgtggcagcttattcatgattctacgtatcgggcgttttctaatttagtcacgacggccattaaggaaaatgtggattttgtcttaattgtaggagacttatttgaccaagttcaacacagcattagggcggatttgtttgttaacgaacaattcgaacgcttaaatcaaaaacaaattccggtctatttgagttatggtaatcatgattatttaaatgacaatacggaaattattaattatccgaaaaatgtgcatgtcttttcaagtaatcctcaaaaagagcagttgacgctaaaggatgggacgaccgtttctatcattggctttagctatgataaacaggctgtgaaagaagatattgtggccgaatttccagcacgtgatcaagctgatttcgaaattggtacggttcacggtagtttggattctttaaattcaccagaagcgaactacgctcccttttccaaaaccgaattattaaacttacactatgattattgggcgcttggccatattcacaaacgtcaggttctaaatgaagatccggccattatttattctggtaatttacaaggacggcataaaaatgaaccaggaacgaagggcttttatttggtttcaagtgagggggaaaaactcattccgaaatttaaggaagcctcagtgattaattggcaaaaactcacgattgaggtgacggcggccgacacgtttgatgagattgtgaaaacaattttacatcacatcgaaattctgcttgataagcaacctaactttattgatgtcaaaataaaaaatgtccagaccttatctggagcggttttaacaagaattaaagatggtagtttattagaagttgttcagcaaaagcttcttaaaaatagccaatcttgggtttatgaaattacaccagtaccagctcaagaactatccaatttgagtgctttggatagtgggttttgggagcaaagtcgcaaaaagatttttactgaagaaaacgtgactcaaattgcggggaaattactgaattattcatttattactgaagccctaaatgaaaagtctcaagatacacaactccaggatttagcggaaactttactacttgaaaatggtggtcgtgaggagcaaaacgatgaagatactaaagattaatgtttatgggtttggcaaatggcaagaccaacagtttgatttaacgaatggcttaactgtgttttcaggtcccaacgaagccggaaaatctaccttacgccagtttattttaagtgttttgtttggttttcgcaccaaaagaggagctgaccgttatttgaggtatgaacccaaaaatgggtccaaatacggcggtgagctattaattgagaaccatgatgagcagtacttgttgacccgtgtaaagggaaaaagtggcgggaagctaaccataacaaatgtggcaacacaagaagttttggcaaatgatgagttgagcaatttgttgggttcggttgatgaaacacttttcaatgagatgtttagttttagtcaaagcgaattagccgaggtgcgccaattagatcgggatgaatttcgtaaacgagttttaaaaattggggcagttggcagcgatgaatggattggcctccagagttcctttgaaaagagtgccgataaaatttatgctcctaaaggacgagtgcggccattaaataagttactcaaagaatatgattcactgaaatattaaattgaaaagcaggcaataatctagtaagattgttttgtttacgtactaacttaagaaaggtcttactcatgaaaaaatttaaacacctcaccacgctgggattgctttccggcatggcccttcttttgagtggctgtgtccgaacaaccaagtccggtaagccttacggagccgtctatgactatctggcccgccctgctcaggcaattatggaatggattgcccaatttgtcggtagttacggctgggccatcatcgtcctgaccgtggttgttcgcctattcctcttgccaatcatggttcgccagatgaaggcttcaactattcaacaggaaaaaatgcagttgattagaccacaaatggctgaattacagaagcgtcaaaaagcagccagtacccctgaagaacagaccgctgccagccaagcaatgatggcattgtacaaacaaaacggcatttcgatgaccggtgggatcggttgtttaccattattgattcagatgccgatctttactgctttgtacgccgcaatccgttactcgccagagctgtctcacacagttttcatgggcattcgactcggccaatcaagttggctgttagccgttttgtcatttgcttcctatctactacagggctacattgccatgctgggcacccctgcagcgcaaaagaagcaaatgggcgccatgatgctgctcagtccaatcatgatcctggtgttcacgctgagtgccccagccggtctgggaatttacttcttcattggcggcctattcgcatgtttgcagacgttgatcatcaatatgtaccgaccaagaattcgaaagcggatcgccaaagaaaatgaaggcaaaaaagcagtgacggttgaggatctgatgccggatccaacgccgagtaccagtgggacaaaatcgaccggttccgatattcaccaaagaaatcgtcaacgaaataccggcaagcagcaatccgggcatcagcctcaggctcgtccagctgctcagccaaccaaaaagacggtggataagcaagctgaaaaaccagcggctaagcgtcctcgaaacgctggtaaacaacaaagacatcataaataatcacactcaatcacatcttttggtgtgatttttttatttctgcaagattttgagtgatatgacacccaaactcaggataagaatggtaggatattcatgtatatttttcaggaaaagagttgttttcgtttatgaatcaaatttcgctattgatcattctcctggcggcccttgtcatcccattggcaatggcccgttttaaaatcacctttctaccaacagcggttgttgaaattattgttggtatcctgctgggaccgtcactgttcaactggatcaccaactcggaaaccttggagattctccaaaatgtcggggtcatcttcctgttgttcttaagcgggatggagattgatttcagcctctttaaaaagaagcccaccactctttcaccgctcgagaagaaaagccagcatgatcagccgaagtactcagtattacaagtggctacaatcgcttacgcctcaatagtcggcatgtcatttgtgatcgcttatctgcttcaactcagcggcttgttcaccgatatttggctggccgcgattctgttcatgacgatttcactcggcattgtcattgccgggttaaaagaaaaggagctgcttagcaagccgttcggtcaggcaatcctcttaatcgccgccctgggagaagttgtcccgatggttgggttgactttttacgcttcagcctacagtccccattccaaatccttatggctgatcttgttgattctggttgcagctgcgctcttgttctggcggttcaaagcctttttccgcttctttgatcggatcaacaagtcgaccacccagctggatattcggctttcattttttatcatcgtggccctggtaaccgtcgctgaatcggttggcgctgagggaatccttggtgcatttcttgccggaatcgtcatcaaattacttgaaccgcatgaagaaaccaaagttcgtttggactcaattgggtatggcttcttcatcccaattttcttcatcatgagtggcgttaatttgaacttaaaagaattaattacgaatccacaaacgctggtgttgattcccgtgatttttgtcggctacgttttggcaaagagcttggtattcagtgctttaaaattgcgcttcaagaacttaaacgcagttgctggaactgcgatgactgccaccaccattaccgttgtcttggcagtgctgcaggtagccagccacttacacagaattaccagccaacagtcaggtgcattcttgctgtcagccgtcatcacttgtgtctttgggccactgatttttaataagctgtattcatcagaagccgaggatctcaaaaaaacgaccgtgcactttatcggcaccaatttgacgactgttcctgtagcgcaacaattagccaagggctggtatgatgtgaccatgtataccaacaaccagcacaattatcgggccttcaacagtgaaacgaccatccatcggctggacagtttggaaccggaggtcatgattaaaaacggtgtttttgatgctgatgtcgtggtgtttggtcagattaattccgaaaagaattatgaattggcgaaaatcgccaagcaatatggtgtccggcgggtaatcgtccgattcgaagaccgcaatattttagacgatcgcagagatgagttggatcgactgggagtggagctttataataccccagatgttaatatcagcatgttaagagcgttgatcgaagcaccatcaacaatgcgcttaatgacgtccacagattccagtgtctacgaagttgccctgagaaaccggctgtatgctgacattcaggtccgcaacattccatttatcgacaaagttaccattacccaaatttaccgtgacaagcggtttatccggccaaccggtggcacatcgttaaagctaaatgatcggattatttttaccagcagcaaagccgaggcaccagaagttcgtagggaactcggaaaacttaattagtcataatgactcttacccattaaaaaggcgtcacattcattgcagtttgcaacggatgtgacgcctatttaaacttatttttcatgatgttcatcgtcatttaaaggacgatcatcatgtttggaagtatccaagattccttctgggagtcctgaatcttttgattgttctttggaggttgatgaagtctttttctccatctcttcttcgcttggcagatgctgcaagattggcagattgatttggaaaatcgaaccggaaccaagtgaactttcaatcgaaatgttaccatggtaagcttcgatcagcctgtgggcaattgaaagtcccagtccgttaccgcctttgtcacgactgcgggctttatcgacccgatagaagcggttgaagaccttttgcttatcctcttcagaaatcccctcaccaaagtcctgaacggcaatgttaaccatggccatcgatgtagacaatgacaggtggacttcttttcgcttggttgaatatttaatggcattatccaaaagaatcaccaatacttgttcgagatgattccgataaatcttaacgtaaacgtcgtgatcggtgtcatcatcaaacgtaaaggtaaaatctggatgaatcattttgaaatcattataaacctgttcaaacacttgattgacatcagtaatttcttcgccgtaattaatttcaatctgttcggcacgggaaagatctaacatttcagaaaccagactcttcattcgattggtttcctgcagtgaagctttcaaagattcttccaagacttcgggatcatctttcccccaccgcagcagcatatcaatatgaccctgaataacggcaaccggtgtccgtaactcatgggaaacgtcctccacgaattgctgctgctggtcaatatagcgctgagtttgatccaacatgccgttcaacagctgagccaagtcggttaattcatcgttggatcgaaaggccggtacccgtgcatctgagtcgggatcgcttttaacttcattaatcgttttttgaatatcattaattggccgcaataattcctgagctagaatataggcaaaaatcatcgtcaaaagaacggaaatcagcaccagaataattaagataaccagcagcttgttagccgtcgctcggtaattgtccaattggtcagtgacctgtgcgtacccaatcaatgagccattcttctttgaaagcagcggttctgagccaaccagaatttgatggccattatgtctggtggtaaaaattttccgcttgctggcagaataaaacttggccgtactcttccgtgattcaaataattccttgccattgacactgtagacattgactaaaatattatcgcgggaaaaattaacgatcaacgaattggaatacaaatcgttgccatcggcttgtgtcacctgatcgttactgtcggtgatctttggcttcaaatagtgtcccacatcgcttttggtcaatggtgaggcataattggtcaaccttgaagaaacggtactcaaggtattgtcaatgtgcgaacgttcctgttgaaataagacgttggtaaatcgattaaaaattaagcatgagaaaataacaacaatcgctaaaacaccaatggacgtaaaaaaagcccacttccattttagcgatgtctttcttctctttggttttgtgttgggttggttcatgaccgcatcacgtaccccgtacctctaactgtttgaatataactgttctcacctggacgatcaatcttgtttcggagatatctgatataaacatcgaccacgttggtttcaacttcggaatcatagccccatactttggtaagcagaacatctcgagccaggacaacgtcaacgttttccatcaaagtcagcaacaattcatattcacgctttgtgaggttaatcacttcatcgccacgacgaacaattcgactttccttttcaatggttaagtctttgaacgtaactgatttcttgttgttcttttgttgatcattttcgatttgaattcggcgaagcaaagcccggattcgagctaagagttcctcaatcgcaaagggtttgacaatgtaatcatcagcgccatgatcaaagcccgaaactcggtcaataacagagtcccgcgcggtcatcatgataattggtgtgttcttcttttcacgtaggcggcgggcaacttccattccgttcaattcaggcaacatcaaatcaagcaaaatgacatcgaagttctcatccaatgcagcctgcaaaccagttctgccgttaagctcaacttgggtatcgtagccttcgtgctttaactccagttcgacgaaacgtgctaagttcttttcgtcttcaataatcaaaattcgactcataaatgatcagctctcccataaaatatcttaatttgtttattagtaacgtagaaaccttttaacataactctcattttaccataattatgagagttttagtcttttactttaataaaacttagaaaaacggctaaaattgcttggaaatatttttcatttaaactaattttgtgtagaaattcacttgataatgcccaaggggacgtttataatgaacttgtttgaaaatatattacaaaaaggatgattaaccctatgaaagctgctgttgtaagagacccagttgatggatatgttgatattaaagatgttactttacgccccattcaccaaggtgaagccttagttcaagttgaatattgtggattatgtcacacagatttacacgttgctgaaggtgactttggtaaggttcctggccgaatcatcggtcacgaaggtgtcggaaaagtcattcaagttgccgacgatgtcactaacttaaagattggcgaccgtgtttcaatcgcttggttctacagaggctgtggtcactgtgagtactgtatcactggccgtgagacactctgccgtaacgttcaaaattccggctacacagttgatggtgctatggctgaacaagtcattgtccctgcagactacgccgttaaagtaccagaaggacttgatccaatcgaagcgacttcattaacctgtgccggcgttacgatgtataaggcactcaaagttggcgacactcgtcccggccaatgggttgaagtcgttggttgtggtggcttgggtaacctcgctgttcaatatgcccataacgtctttggtgcccatgtggtagccgttgatggtaacgagcaaaaacttcaagcagctaaggacaacggtgcagatatcaccatcaaccgtcatgatccagatgttgccgatcaaattcaaaagaaggttggcggcgtgcacaatgctcaaattactgccgttacaactgaggccttcactacatctgttaacgctttgcgtccagatggcaagttggttgctgttgcccttcctaagggtgatatggcacttaacatcgataagacggttctcgatggcattcaagttgccggttcactggttggtaccagacaggacctcgctgaaacattccagttcggcgctgaaggcaaagtaaagccaatcgtacaaactcgtcgacttgatgaggtcaatgacattatcgatgaaatgaaagccaataagattgttggccgaatggttgttgattttactaaataaatataatattgatccaaatgaattaagggccaccagcgaaacgcatctcgctggcggccctatttttatgtatataaaaaccaatttagaatccatggcgttctaaattggttattaattacttgttatctttgataactttacggcctttgtaaaagcctgatggtgatacgtgatgtggcatggtgtattcaccggtctttgggtcgaggctcaaattaggagtcgtcaacttgatgtgaccgcgacgcatgcgctttcttgctttagaagttctacgtgctggtgtagccattctttttccctcctcgtcaaaataaaatatccactagtgaaattttaagtccagctatttcgaatctcgattcttaaaaaagtccttcaattcggccagacgtggatcaacggttttcaattctgccttctgcttgctgtagtcatcgacggacataacatcccaatcgtcaccacttggcatctctttgcctgcaagttcttcaggagacaggacgtgcataggaatatgcaaaatcacattatcaacaactgccctttgcatatcaaccatatcatcttcatctaaaacaaagacaacgtcatcttttccataccgtgattcagcagccttggaaggaacataaaactcctcaactgtaaaatcaagcggtaggtcaacgggtgtcaatgaacgggatgacgggacgaccaacttcccaacaatatgggagtcaataatcacatcaccacgatcggcaaaagcagttccttcaacgtgaaagtcggatgcatcgatcacttcatcagcgtagcgatcaagcaaatcggctttgatttgaaggttctcgttgaatgtgaaaggatcagtatccgagtacttttgcaagtctctaaagtaccatttcaatataattcctccaatgcaacaaaacttattataccggcaacaaataggcttgtcaaggcaatttccttgataggagtttacggattattccaggatgattggatgtcgataataatcttgagacaagccgttaatcatctgggttaacatcccaccccgaaaatccatttggattgtgtcggcaacaacgtcgtcagtaattttggtaatcaatggaacgtcaaggtctcctttgatttgattcaagtatctttgacctaccgcgttaaagcccaacagccggacatatccggccgcctgaagcatatcacttggaactgcatgtaacaagacataggtacacagtcgctggattcttgtatacgtataacgcttggttttgaccaaatgtaggaactcggtgaagctttctgccttgattgcggcccgttttaaacggtactcaattccctcggtcatttgataaatctggtgaagcttttcaatcggactctcaaccaattcaaacctgagaaacggccaaaaatcttgccaggtgagcattcggtcatgctcaagcatccccattgtccccttgggaaccactcgatcagcagccttcaagtcatgtttaaggaccccttggcgaatcgctgtcgcactggcaatagggctggcatcgtcaatttgagtcgcatcatgttggctgccctttcgcttgattggtaccagcgaaagcggcctgcctgtttcaacattggcttttgcgtatccaaatcctaagacatcattgggttgattcaaccgaatgccggttttctcaaatagataatcctggaagacggaggcgtatggacgatcaaatcgtttaaagtcggcaggattttttggctgatggtcaatcagcttttgataatccatttcaggatgctcagcaccaaaggccaaccaccgacacttcattttggcagccaaatcaaccgccccttttgagaataggtgggaaggctgaaccgccgaaaataatggcagttcaatgaccaggtcaactccacccagcagggcagcgtgagcccgttgccatttgtcatacgcagccggttcaccccgctgcagccaattgccgctcataatggcgacagtaacatctgcgccggttgcctgctttgcctgttcgagcatatataaatgtccattatgaaagggattgtattctgaaacaatcccaacagcttgaagcatattctccgacttccttaatcttttcccgtactaaagaaccagcgcttggtttcccgtacgaaggggttgtccccaaaatcggtgcttgccagagttaccaagaaaccagtctgtgacagcagatctttaatcaccgtgtcatcgtaagcgcgctcacgatggacttcattatacgcatcataagcatccttctcctcattgtattggaagaagttcaactcgtgttcaacagccattggcgcgaagtcaccttcgtagctggtccacataaaagcggcatcttcactccgatagttgtacatataaccaggataaacctcggttgcctgataaggtgaaatcacgtcaaagagaaactgaccgtccgaattgagatgatcatacactgctttgaaagttgtctccaaatcattttgatcaatcagataattcaaggaatcatcaaaacagcagatcaaatcatactgatcaaggccgtccagattgcgcatatcagtttgaataaagggcacgtcaacacttgcctcgcgtgctctttgctcggcaattgtcagcatgtcctctgatagatccgccccagtcacctgaaaccctttttgggctaatttaatcgccaagcgaccagttccgcaggccagatccaaaattttaatttctgaaggcggtttttggatcccttttgtcttgttcacaacaaaatgggcccaacgatcatagagagttgcgtcaaataaatcatcataaaatttggcgaattctgtatagatcattatgcctccacccacgaatcggtattaacgattggggcatccgaccataatttttccaaattgtaaaaatcacggacatctttctggaaaatgtgaacgaccacgtcaccgaggtcaattaaaatccagcgggcagaatctttaccagaaacactgtagacattgacgtcatcggcttcaacctgatcaacaatttcatcggcaatcgccttcacctgtcgactggaagctgcgtcagcgatgacaaaatagtcagccatcagactaaccttttgcatatcgagaaccacaatatcgttggcacgtttactgtctgccgcacgaacaacgacttctgaaatttctttactgttcatatttactccttaatctattcctgaacttggtacccaactattataagtcatgattgtctgtggaaaaacgggcttattgtgggcaaccaagtatcccaacgtttgtttggtttggtaggcaacgccatcttgcagattattcttggtcatcttgcgtgcctcatcgacacctggaaaatcccgacctggttcaatataatcggccatatagacaatttgttccaacggcgtcatatactggtgcccaactgtatggtacctgacggcgtttaaaatatcaatatcggtgatttgtaactcatttttgacaaacaaccaaccaacaacaccgtgccaaattgcgttgccataattcagcagttcagggtctaattgatagtccttgattgcttgaataaaatcgtcatccggacgttgctttgcatagtcgtggaccaatccaccaatcgccgccttttcaacatcaaccccgttttgttctgcgaggtccatagccgtctgctcaacacgcagacaatgctgaaagcggtgatcactgagagcggcgcgtagtttgccaaccaactcgtcacgagtgtatggaacgaaatggccttgatagattagttgatcatttttcatataaatggttctcctttatataacgttcaacagcggccggaaccaagtacttaattgactggtgctgtcgcatttttgagcgaatcagcgatgatgaaatatcgatgaacggcacgtcaacccaaattaccgggtatttggaagctggtgtgtagccgtcacgtttgacaccgacaaacgaaaccaatttgaccagatcatcgattcgataccattttggcaggtaatcgaccatatcaccaccgataataaagtaatattgattctcgggatgctgttgggtcaactgtttcattgtgtcgtaggaataactgacgccgccacgcataatctcagtcatttcaatggcaaacttgggattgtcccgaatggcgcagttaatcatggccacccgatctttggcatcaatcgcaaatttccggtcaacgtgcggtggattggcatcaggcataaagtaaactttgtcgagccctagttgatccaagacctgttcggcaataattaaatgcccgttatgaattggattgaaggtcccacctaagattccgatgcgtttaccgttttgttttgtaattgttttcgtctgggttaatgtttcgacatgattcatgacgttgctcatccttcattacctctaaatcgccaaaacttcgttggataatttttgcttatttggatcttttgacggcttgaagagaaccaaagtcttcccaatcgtctgaaccaccgtcacatcacttttggtttcaatatagtccttgatgtcatcgacggttgctgttgagttttgtaaaacattgattttaatcagttcacgcgtatcaagtgccttttgaatctcttcaagccaaactggtgaaagaccgtttttaccaacttcaaagattggccgcatgcgattggcattggctcttaaaaatcgtttttgttttcctgttaatttcataagtccctctttatttaaatcattgctgggcgcatcaaaacggatacgcctttaggagcccatccagtgacggaaacgccctctggaacagttacccaacccaagccctcaatcactaaatcacttttttcggtggacttaaattcatgaggttccaatgctggaaaatcagccttttgatcttcggttggcggtgttagaaatgaacccacatgagtagcgtaaaactcatcggcattttctaatttcgttcgatgaatgaataaattattctcagcatagactgtgaatccatgacgcttctcaccagagttgtaatcaaaacgggcaacgccggcaaagaagagtgtttgacccggatttaactggtaacctttcggcttgattgttttttgtggcgtcaccaaattcaattctttaccggacagatggtgggccatttgctcaggctggatgatccctggggtatccactaagttatgaccgtcattgagcggaatgtcaatccgatccaatgtcgtccctgggaatcgagaagttgtgattaactccttgatgccagttgactggcggacaattgagttgatcagagttgatttaccaacattagtaaccccaacgacataaacatcttttccctgacggtacttttcaatttgatccaacaaacgatcaatatcaaaattcgtcttagcagaaatcagctcaacatcaattggccgaataccggccgcgttagcctgttgtcgcaaccaatccttcaccttgttatgcttcaaggctttgggcaaaatatcgagtttattaccaaccaacaggaccggattgttgccgacaaatcgatggagaccgggaatgaggcttccgttcacatcaaaaatatcaaccacgtacacgatcaaagagtcagtatcagaaatactggttaacagctttaagaagtcatcatccgataaactgacgggagcaatttcattatagtggcgaagtctaaaacaacgctgacaatagacctccccattttcaagccccttcttcaaagcagattcaggggtgtatccgagtgcgttcttgtcagtcgtctggacagctgccccacaacccacacaatgaacgacttcaccgtcaacaacaacttcattatttgccataattcctcctatttccaatgtaaatcaggatattttttcgataatttattccagacaatcttttcaaagtaacgattgatcgtggtattccaagcatcgtcacgcaccagtggcttcaccaaaatgctgcgaacaccgcatctgttggcagccaccacatcagtcatcaattggtcgccaatcataacagtgttgcgcttttgtaaattaaattccttgagagcgtgccggataccgatagtgagcggcttcattgccctgggaacaaacggcagctcgtaatcttgaaccgcgcgttgaattcgcttgtgactgttattggacacaacaatcaccttaatgccaaatttcttattttctgacaaccagttgcgtaacgcttgagaacccttcttggagttccaaggtaccaaggtattgtctaaatcggttagaacacagttgatattatgatcccgcaggaattggggagaaatcgtgtaaatatccccaatcatccatgttggtttaaatcgagacaacatatgtcgctccttaaattatagtaaatttatttaaaaaaacttccaccaaactatcggtgaaagtcattttagcacatcaaaattacttaagtgcttttttagcttcgtcagttaaagctttgaaagcttcagtatcactaactgctaaatcagcaagcattttacggttcatgtcgatgttggcaagcttcagaccgtgcataaattggctgtagctgaggtcattaagacgagcagcagcgttaatccgtgcaatccaaagtttacggaagttacctttgttgttacgacggtcacggaatgcatatacctgtgacttcataacttggtctttggcagtcttgaataaacgagactttccaccgcgataacccttagctaattttaaaacacgcttacgacgtgcatgtgtgactgttccaccttttactcgtggcattttgaattcctcctatattttgaaaagtaataattgaatgtatagttgattttatagatgtggcaataacttcttataagttttgatattagtcttgtccatcatactagtaccacgaagttggcggcgttgcttctttgtcttaccgtggaaacggtgactggtataagcattggcactcttaaatccaccgttggcagttctcttaaaacgttttgctgcagcacggtttgttttttgtttaggcattggtaaaaatcctcctcaagtatttaacaactattatttttgatcttggtcttttggtgaaagcattaagaacatgcttcttccgtccatcttaggtcgttgggtaacggtggcaacatccgccgtttcagcagccattcggtcaagaactttccggccgatatccttatgcgtaatggcacggcccttaaatcgaattgagacccgaaccttttcgccctttgccaaaaacttcttagcattcttcaatttggtgttaaaatcgttcacatcaattgttgggcttaatcgaacttccttgacactgatgactttttgtttcttacgggattcacgttccttcttctgcaactcgaaacgatacttcccataatcaagaatctttgcaaccggtggcttggctttcggtgcaaccaggacaagatccaagtcggcatcttcagctaactgaagagcttctgacttagtcttaacaccaagttgatcaccattagcaccaatcaaacgaacctcacgagcacggattccatcattaaccatcatatcttttgctatggtacttcacctccgaataatttgaaaaagcagaaagagagcgggcacacatttgcgcccgctctcaattaaagaacttggctgaccaagctcttactcgatatcatgcccagcaaattcagaaatttactcaggcgagaagcgggtagctcctgctttcatttgaacaactattacagaatatcatctaatcacttatgtgtcaactatgaaccgttaagcacattaataagtgactcagtaattcgttaatcttcttcgcgtgaatatgaagcaatgtctttagatacttcatcaatgaagtccggaactgactctgattgggtatcctgctcaccatacttacgaactgaaacgctgttgccactcacttcttcatcaccgacaactaacgtatatggaatcttgtgagtctgtgcatcgcggatcaggtaacccatcttttcggcacgagtatcaactgacgaacgaatcttcaatgcccgaagttggtcgttaatcttcttagcgtaatccaggtgcttgtcttggctgacaggaataatcttaacttgatgtggtgctaaccaggttgggaaggcacccttgtagatttcagtcaggtaagcaacaaatcgttccatggtagaaaccaggccacggtgaatcatgactgggcgatgttgtttgccatcttcgccgatgtagtgaagatcgaagcgttcaggaagcataaagtctaattgaatcgttgacaaagtttcttcatttcccagagcggtcttggtctgaacatccagctttggaccatagaaggcagcttcaccttcggcttcaacataatccaagcccatttcatccatggcacctttcaacatggtctgagcacgggtccacatttcatcgtcatcgaagtacttttcggtgttcttcgggtcacggtagctcaaacggaaggtgtaatcgttaatatcaaaatcgtgataaacctcaaccatcaagttcaagatattcttgaattcttcttgaatctggtccaaggcgacaaatgtatgaccatcattcaaagtcatttcacgaactcgttgaagtccggacaaagcacctgatttttcgtaacggtgcatcattccgagttcagcgatccgaagtggcagttcacgatatgaacggatatggtggttataaatttgaatatgacttgggcagttcattggccgcagttcaagctcttcaccgtctcccatgtccattggcgggaacatgtcctcacggtagtgatcccagtgtcctgattgtttatacagatcaaggttggctaaaaccggtgtgtaaacgtgttggtatccgttggcaacttccttgtcaacaatgtagcgttcaatggttcttctgatcgttgcaccgtttggcatccagtaaggcaagccggcaccgacttttggatcaacaaagaacagatccagttcgttcccgatgactcggtgatcacgttcatgggcttccttgcgcttctcaaggtcggcatccaaatctttttgcttgttaaaagcagttgcataaatccgttgaagcattgggttggatgacttgccctgccagtaagctccggcaactgagagcagcttgaagatcttaactttgccggttgatggtaaaacagctccttcggcgattgactggaagtcaccgatttggaagaatttaacttggccgttaacttcgtttgctttgaccaattctttttgataaggatcgtcgccggcaacctttgcagcgtcatcagcgcttaagaagaccaccttgattggcagatcctgtttgataatcttatgcattgaatcttcaagtgcactcaattgatcaacactgatttgagtgtcaggtttatcggtatcaacgaagaagccgtcttcatcggcatcgctttcaccaaagtggatattatcaaaatcattggcaattgccattttcaaaatctgggcggcagttgcgcgtaatacactgaggccttcgtcactatctgacgtaacaatttcaatcttgccgcccttatgtaggggctcgtcattgttgacccattttccgtcaaccttggcggcaacggcttttttacctaaactgacggcaattgatttggcaatggcttctgaggtaacgccgtcatcaaattgtttaacactaccatctggaaattcaaatgaaagttgtgacatatttcttactccctttatatttttattggagccacaaaaaaagcccctgacatacttatacaagtacatcagggacgcaattagcgcggttccacccaaattggatttttggatacaattatccaaaaagctctcaagtggctgctaacggtaccaaccgggaaagcattatccgcaatccattctcaaagagtggtaacaaacaatttctcaacaaacggtcttccaggctggaaccattctccctgtgatgagtcatcactgtcatgtctctttgattcattgacatttagtatagagttgccgttcaaaaatgtcaattcaatttgtaaattaaactggtcgccgatttttaccagtcatctcgacctcacgagacaagaatcgaattcgctgcatgagtcgtttggctttcaatggttcatcgtcgcctttttgattgatacgcaaatgttcctgttcgagttgggccattgaaaaattagacgtaaaaaacgtcggtagctgctgttgcatccggtattccaaaataacgcccaatacttcatcacgaacccacgaggacattgagtcagccccaatatcatcaatcatcagcaccggcgactttttgatcacatcaattttttcggtgaccgagttatcggtgatcgccgatttcatttcgacagcaaaacttggaaaatggaccatagtggtttgaatcccgttatcggcaagttcgttggcaattgcacctgtcaggtatgttttaccgacaccaaacggcccatatatgtacagacccggatggaaagtctttttgtcggccttcatttgagcaataaaatccaatgccattgaaagggccgtataacgattggggtctggattatcgggatcagccccgtcgaattcggcgatccgggcatccttgatatctttaggcattgaaaccgtcttgattcgacgcgccaaggactgactgcgctgcttttcgatgacctctggagaggccgaatacgcaatatcaatcaagtgatcgttaatgaccaattggggcaaatacccaggcgcaaatgattgtttcttggccttaatctgatttttgacattcacatactcatacagtttggcagcagaacggtcaaccgcatcaggagccagttcaccttgatgatcctgaagaaatttggcgatctcagggtcatttttgatctgttcgataattttttggaaacctgatgcgacattgccacccttaaattgacggtcttccattagtttcttgacgaaatcacttactttttccattcaatctcacctactccccggcttttttaacttatcaagctgtgctttaagctgcttcttttgggcatcagtcaactgtgaggttggctggctggcagaggaaggttgatcatccttcgcccaatccggcagggtctctttgacattaacccgtcgctgtttgtacttggcagcccgcttatcagcttttttctgtttgtcgattgttcgattcttaatggcatcgattgcatgctcggcatcaaaaatcccgtgttgtgaccaatcatcggcaatcgttgacatcaggtttttattgagagtcgaacgattttcatcaactaataaatagtaaatcaaaatattgatgacttcattcggcaacacgcgcaggttgacaagctcgcgcaaggttcgctgctcaccgctggtcacaataccgtgcttttgtttcttgatttgttccaaaaacacgacaggagccgtctttttactaattgaaatcagttgagtggttgccgtgtcgaattttgcagaagaaggcgtgatctcggcagtaggtgctgccttctccacgttctctgcttgatgccggctgaaattgtcagtaataattgccttcaactgtgattgattcaattcattggtgctgagattagttgccttttgaatgagtttagccatttggatctcatcaattccatagagcaaattctctgacaaaatcaaatcacgagcggctttaacagagttaagatcgacgtatgaattttccaacatgcttaataggagtttgaagttaaactggtgactatccggttcgaaactgttctcactgacatttgcagctgatcgaacaatggtctgcttggcgtcgttgactgcgcccggaatgtttttaatcaggttctggggcacagcaaataaatccagcagtgaagccgaaatattggtcgtctccccgagatccggaagtggcagcactagtcggtcgacaatctgcttgtaggttgtttcgcccactttgctcaataaaataatcgacaaaatatcggttcgtaaaaactgttcagcagttagcggcagattcaacgagtagatcaagacatccggtttgttttgggaaaccaaagtattgatcagtttaacgccttccaattgctttcgaatcgccaccagctggtcaattttgcaatttaacatgctctgaatttcgtaatgcttatgcaaaaccaactgattatgatcatttaagctcatcgaccacaacaaattgtataatcccaatgctttttcaccaatgattggtagatacaaattggttagaacactgtgatcaaggctccgattaatatgggcattggtcgtgagatattttgtatcgggtgttaatttatcgaacgactctgccattatttgtcccccgagtgatcctgaccctttttcttatccttttccataatttccttaagctctttataaaagaccgacatatccttgaattgacggtaaacactggcaaaccggatataggcaatttcatccaaattggccaaatcttccatgacgtattcaccaatttgttggctggaaacttcattctcgcctagtgaccgcaatttattttcaacccgatccaccaaattggtaatggcatccatcgaaaccggccgtttttcagcggacctgacgatcccctttaacagtttttcacggttaaattcttcgcggttaccatttttcttcaccactaataacggtgttacttcgacccgctcaaatgtggtaaatcgaaaaccgcagtgttcacattctcttcttcgtctgatcacccgaccgtcatcagttggccggctgtcgacaaccttggaaccattgtatccgcaatgaggacattgcatggtgttcacctcgtctatttcgtttccttcgccaaccatctgtcgacttgtgtcagcgttgttgtcattgttcctgagttataaataattgtatcagccaaatcgcattttgtctgcaatggccattgatttccgattcttttaattgcacttacaatactcagtttattgcgttttatcaatctctgcaactgagtgaccggatcacagtaaaccaccaccacctcgtcgactaagtggacatagccattttcaaataaagttggtgcgtccaagacggtcatttcagtatcccgataacgtttcaactgagaaagaatctcttcgcgaatgaatgggtcaatgattcgaaccagttgtttgagatcagctggattgttaaacacaatccggccgagtgcctggcggtcaagtgcgccgtcagccagcaaaatccgctgtccaaatgcgtccaccagtgcttggagcccaggagtcccggtttgttcaacttgatgggtcacgatgtcagcgtcaatcacaggaatcccctgctgatgaaggtaatcgctgaccactgattttccggtggcaatcccgccggttaagccaattaatttagtcattttttacaccacgtaaaggttggcattttgggcaaaagtgggtgccccgctgagccaacttgattttaacaatctttgtgccgcatctcgagcagggttcgccttcacggccgtaaacattcaattgattttgaaaactgccggcttccccatatgcagttgaatatgagtggacggtcgttccatgaccggcaatcgccttggctaattcgacgataatattttttcgcaactctttaatttgtctcaacgtcaacgtgttggcaggctgttgaggattaattttgcttagccataagacctcatcggcgtaaatattacccaacccggcaatattactctggtctagtaaaaatggtttgatcactttgcggctcttaccaaaaattttctgcatgtaatcgacggtcaaatcatcttcggtgggctccggtccaatcgttttcagaccggcaacctgcatttcagtgccagtatcaaccaaattcattcggccaaattttcgcgtatcattgtaacgcaactggcgcccatcggtcagatgaaaaatgatatgggtatgcttaccgaccggtgcatcttcaggctccacatcgtacttgccttccattctcagatgagaaacaatcgtcagattatcgctcagtcgaatcagaaggtatttaccacgtcgatcaattttttcaatcgttttgccacggagggcttttttgaaatcgtttggtggtaaattaatcattttggcatacaacacatccaccgattggatggtgcttcctttaaccaattgggtcaggccgcgtctaacggtctcaacttcaggtaattcaggcattgagatcccccatttgcttcaacttattttgcatcataccaggtcttaccccagtggctttcaacttttaatggcacattcaagtggatcgctgaatccatgacgcttggaatcagttgtttgacggtgtccaattcctcgtcaggaacttcaaaaattaattcatcgtgaacctgcagcagcatgcgggttttcatatccttgattgcatcggccatattaatcatcgcaattttgatgatgtcggccgcactgccttggattggtgtgttcatggcagtccgttcagcgaatgaacgcagattaaagctcttggaattaatatccggcaaataacggcgtcgatgggcaatcgtctcaacgtagcggtggttacgggcaaattcaacgatgtcttcggtatattttttaacgccgggatattcttcaaaataacgttcaataaactgatgcgcctgttttctggtaatgccggtattggacgctaaaccaaaatcgctaatcccataaacaatcccaaagttaactgccttggcctgacgccgaagttccggggtgacttcttcatttgacggcagtccaaaaattctccgtgccgtggtggcatgaatatcctcgccatttttaaaggcgtcctgcatattttggtcgtcggtaattgacgccaacacccgcagttcaatttgagaataatcagaggagaaaatctgccagcctggatgtgatggaataaaggcctggcgaataagtcggccttcctcggagcgaaccggaatattctgcagattgggatcgactgaagacaatcgaccagtctgggttaacgtctgcagatatctggtgtgaactttggaatcatctggatgaatgacctttaatagcccatcaacatatgtcgactgtagtttggaaatctgacggtagtccaacacattttgaacaattggtgcatccggagccagtttctccaaaacatcaaccgaggtcgaatagccggttttggtcttctttagaatcggcaggcggagcttttcaaacagaatctttcccagttgtttgggagaaccaatgttaaattcttcaccagcttcttggaaaatggtctgttcaatttcagcgagccgctctttaaacttactgcccatgccctccaaagtggctgcatcaactttgatgccattgatttccatgtgggcaaggacaaaggcaatcttgatttcgatatcccagtacagtttggattgattatgggcatccagatccttaaacatcccgtcgtgaagagcatcaatcgctttgaccttatgaaccaaatgggccaaaaaggcaggtgattgcgggtcaatgtgtcgcttggcaccctttccatagacttcttcatcggttttaacattatagaatccgtgtaaatgggcaacggtgccgacgtcgttgctattattagttgtattaagcaaatatgataccagcagcatatcgaagtccacgttggcaagctcaatcccttgtcgataaagaccgacataggttcgtttggcatcaaaaaggttctttttgatggtcttgctggtcaggaggtcactgacatgctgattgtgaagcaattcaggatcgttggtcacataccatttgttaccctgtccaatcgcaaagccaaccaatggcgatgtgtggtagttttcttctgacatttccaggtgaaaagtcacttcatctgtgaactgatccagctcagccgcattcttggcggacaagacagtgtattgaatatctgcttgatcgtcggcatgatcctgatcatcaacagataacttggccagaaacgatttgaagcccattctctcgtaaaaatcggtcagtttatcgatattgtctccctgatacttcaactgatccaaagagactgttaccggcgcgtcgcggttgattgttgccaacgtgtgggcgcgctcggcctgggcttggtcatgaatcaaatgttcctttaattttttaccggaaacctggtcgatattttgatagagattgtcaatcgtgccaaattgttgaaccagcttgacagctgtcttgtcaccgactttttcaacgccgggatagttgtcggagttgtcgcctttcagacccttaatttcaataatctggctcggtttaacacccagcttttcttcgacgtgtttgggggtatatgtttccagttcggtgacaccctttttagaaacctgaaccgtggtcttatctgaagttaactgggtcaaatctcgatcgccggtgacaatcacaacttggtagtcaccagcttcttcagcctttttggcgagcgttccaataatatcatcggcctcataatccggtaattcataggtggaaatgccgcgggcgttgatcaattcttttaagaagggaaattgctcggaaagttcagttggtgtcttagctcgaccgcctttataatcagcgtacattttcgttcgaaaagtggttttgccggcatcaaatgcgaccagcacatcggtgggcttctcgtctgctaatactttgtccaacatccggttaaagccataaatggcgctggtatgtaggccagatggattggtaaatttgtccatggccgtgtataaagcataaaacgctttgaaggcaatactattaccatcaattaataataattttttagtcattaacttctcctctggtgaaaactgttactttaattttaccacgacagataacaaaaaacgatcaaccaaatcaatggccaatcgttgtgacgaagtgtgaattaacggtcgttgttgccgaaaatcgagagtaattggagaaacaggttcacaaagtccaagtacaattgtaaagcaccaaagactgccaaaccggtcatggaaacatcaccattaccagaatattggttatacatctgcttcatcttttgggtgtcataggcggttaagaccgtgaagattaacactgcgatgatcgagaaaacaaatgaaatcactgaactgcgcaggaagatgttaataatcatggcaatgattaacgcaattaaagcagcagttgcttgggcaccccaacgatcaaggttcttgtgggtgactaatccaacggttgtcattgtgatgaaaattgccgaagcggaaacaaaagctgccgcaattgaggcacctgtatacgcccacgcaatcgtggcgaaaacaaaaccacttagaattgaatacaacatcagtactgtaaacgcgagggtcggccgtttcaacgcttgaagtgagatgacaaatggcaaaacaaaccacaaaatcattgatccccacatcacaccttggtgacctgcaatgtaagccgccattccaccagcaacagacccactaactaaaaatgctgttgctgcagaaactaaaacggccaaactcatccagccatacattttagttaaaaaagcattcaacccggctgcgttgttgacgactcgtcgagcttcctgttgttcatttggataattgttcattaaatccgctcccttttgtttgtaagttcaaatattgcctcaaacaatttgcagtatttatacttatactgttaagtaattctaccaaataaaagccattaatcaagtatttaggactcaactaacagcttttataagatatcttaattaatttttttgcttaaatggcttagcagatcttcgtaagatttttcatacttttgaatgtcgccagcacccatgaaaataaccacgtcgttatcgtagtccaatagtggcgacatattgtcaacggacaaaatgcggccacccttagtgatcttcttagacaggtcctcgctggaaacttttccgtgactttctcgcggcgaactgtaaatcgaggtcaggaaaacttcatcggccaagttcaaactcttggcaaaatcatccattaaagcgatcgttcggctgaaagtatgcggctggaagaccacggcaatctttttgcttggatattcctgacgggcagcatcgatggttgccttaatttcagttggatgatgggcataatcgtcaatgatcgtcatcccggcaatcttacgttcggcgaaccgacgcttaacgccttggaaagtcttcaattctttgcgaatttcatccaaatcaacatcttcaaagtaagccacggcaatcacagccagtgaattgaaaatgttatgctcaccaaacaatggcactgaaaagtttcccagatttttacctttataagtgacatcaaagctcgaaccactggtcgtccgcttaacatccaccgcttggaaatcatcagtatccttgaggccataataatagattggtaccttggcttttagttgacggagacgtttatcatcaccccaggcaaagatgcccttcttcgtctggttcgcaaacgtttgaaatgcatcggcaacatcgtcgatgctcttgtagtaatccggatgatcaaagtcaatgttagtcataatggcgtaatccggttcggttgccaaaaagtgacgacggtattcatcagcttcgtagacgaagaaccgggcattgggaacacctttcccagaaccatcaccgattaaataatcggttggtgcaattcctgaaagcacgtgggctaacaggccagtcgtactggtcttcccatgggcaccagaaaccccgatgctggtcttacccttgatgatcttgccaagaaactcgtgataacgataaaccgtcaaccccatgtctctggctttcttaatttctggatgatcatcagtaaaggagttaccggcaatcaccgttaatccttcgtgaatgttgttttcatcgaaaggtaaaattttaataccagccttttcaagcccgcgttgtgtaaacgtgtactggtcaatgtctgacccctgcactttctcaccacggtcatgcaagattaaggccatggcggccatcccggttcctttaattcctacaaaataatataccgtatctgaattcattagacatcctacctatccattatgttatttttgatgattctgctgtgattcccgagcggattcatctgccgccggcttgtaatacactgtccgcggcttggacccctgctgctctgaaaccaagttcttttcctgcaaatgatcaataatgtttgcagctctattatacccgattgaaaatacccgttgaagctttgaagtggaaattgtctcttcattgccaatatattttaaaacctggggcatcaaccgatcctcagaactggtttcagtactggctcgtttcaagctatcaggagtaaataagtatttaggttctccctgttggcggacataatcaacaattccgtcaagctcctgattggtgacaaaagcaccttggagtcggaccggctgatttgcaccactccctagatatagcatatctccgcggccaagtaaacgttctgctccggcggaatccaaaatcgttctggaatcgacttggctggataccatgaaagcaatccgagtcggaatgttattcttgatggtcccggtcacaatatcaacacttggacgctgcgtagcaacaatcaaatggatgccggctgcgcgggctttttgagtgatgcggacaatgtaatcttcaacttcactggaagcgaccatcatcaggtcagccaattcatcaatgatcaccagaatataaggcattttcagcccatactcgtgagcctcacttgcctgtcgattgaactgttcaatatttttagcaccagcagctgcgagcttttcataacgccggtccatttcctcagtgacccatttaagggaagctgcggccgtcttaggatcggaaataacaggtgataacaagtgaggaatcccgtcataaggtgccagttcaactgcctttggatcgattaacagtaatcgtaaatccgccggggtcgctttgtacagcaaagaaaccaacaaactgttgatgaaaacacttttgccggatccagttgccccagcaatcaaaccatgaggcatctttttaatgtctgtcgttctgggaactcccgacaaatcaacacccaaggcagtggtgagtggcgattgactgtcttgaaaatgcttggttgaaatcacttctgaaaggaccaccggcctcggattgggattagggatctcaattccgactgtcgttttaccaggaattggcgcttcaattcgaatatccttggctgccaacgccagctttaagtcatcggttaagttggtaatccggctgactttgacgcccagtgccaatttgacttgaaattgcgtgaccgttgggccatttgtccagtcaaccacttgcgcattgaccttgaaggctgagaaagtttgattcaggatttcagattggtgaataatccagtcatcaattgaatctgattcagcttgctgcggcttggccaacaaagacagcggcggaaattggtaacctctgtcttcagtcggcttctctgagacgtttggttcagccgatgaatgttgaacacccttcgtgggttgattaacgtgattcacttttttaacctgggcattgtgactcagttgttgagcgttaaacaaagaaaggtcagattcgctggccctttggttatgcataattgaattgaatgactgtcccaacccatggtgattcaaagccttccgcggttgacgatttaaatgccgaaccccttggtctgagctgatctgtggttgatctgtcactgatgatttctcaaaggatttcacagatgaattttgaggttgaccttcagtcggcttgacgggctttgttgattgaacggggtgctttagatgctgctcacgaggctgatcaattgttggttgcttattggcaatcacaatgagatcatcatatgtaatcctcagccggcgtgtcaattcatcgtacagacggtgacgacgatgctcttggctgagaaaataattcgtttgaatttgctgtttccgtttatcggattttgaccgcttttgcggcttgaaatttttaatttctttcaaaaaagccggggtctcatcccgacgatcaaacttggaatcagggaccttgcttaaccttgtagcttggattttcggtgccaccggctgattattctgttttgtttcccgctcttgatgaggctttcgggtaatgcccttccgccgaaaaaatgcgggtccatcataatgcttcattactcatccacccaaagtcctttaatcaaataaatgctgtgccttgtgaaaatcaaaggcatcccctacctggtaatcatcaggtaaaatcagtgccccgggaacttgcggtgcgttgggcagccccaactcgcggccggaacaaatcatgccatcgctttcaacaccacgtaatttaccaggccaaataatttggccgtcaggcatcatggctccacttaacgcaacaaccactctaatgtcctcacgcatgtttggcgagccgctgacaatttggacgtccttaccggtgccaatgtcagttttggtaatctgtaaatgatttgccttggggtggtcttccactgatttgacatagccgacaacaaatttgggttgattatcataacggatatctgccggaaaaccgtgatcgcccaaatattggttcaagcgagtaacctggtcttcggttaaatgaacttggccattttcatggacaatttctggaaggactttacttgcttctaaaaagttgtaccccaacgtctgattgctatcagcggcaaaaatccgggcaaccttatcatgaattgtcacactttgttcacccacatccgggttcataatgaggaccattgtgtcacctgtgctgtttgggttataactggttattaacatttcaaaattccttccaacaattaattattttgctacggtacttgcaaggaagctgatcttttttgcccgaacagcgttcggattaattttacaatctaccctatagtcacttctggcagggtggtgactgtactaactgggcatcacaagatagattacatgctgggggacgaatgacttctagccagaaacatgctaaaaagcacttttggtctggaaacagaatttctacaaaacgatcaaaatggtattgtaaacggatgaaatcaacattctttggtgctcgcaaacactggaactattccacaagctggacaacggttaatggcttctaccgatattggacgaaaacgaagcatcgaccacactttacaacaactagttttcggagagtaatggctcatgtccatgttggtgatgtagttcagttacactcgaagaaagatggatggcaccatactgtaactatctcaaaagttacaaagcatatggtgtactatacgtctcaaaacaaaaatagaatttttgcgccgttgacgaaaattaaatcattaactggtctttctaggacaaacaaaatgcgagttattgaaatggggatttaaaaatgaaaaggaaaataatgaaaattgtattcgtagtgatgggtgtacttttcctgacatgcttgttttttacgatttcagtaaaaaatgccgttcgagctaacttgatggtgcatggtgtatcgccggtttcagcttttaattgtaatccaaagttttctccaaaaacgagtaagtcgctacaaattccagtatattatgttcctgacaagtatgcttacaaagatgggagtacaggtgttcatacgtcaacctttgctatccggacgtatttaggaatttttcacgttgctgtcacggctgatcaatactttggatagaaggaaagctatgtaggagaccgatcagttgacctcactactggtgattggtattcacgggggaaagaggaaaagcagatgaaaaaagaatggtatcgagtatttcttctaatgatcatgacatttgccggagcactattgattggatgcaatcagatacatgctgctgcatggcagccatacagtcccaaaattatgggatacgcaaagaagcagcggattctcaaatacaatggaagtaactggggaaactatgaagagatttatgagaagaggtattttaaggataccaaatcaactaagtataaatataatcatcaatctcgggtgatggttattcgctatctgaacaaatcaaaatcccctgaagtaaatacaaagtacaattatcgaaaacttgttttccatggaaacaaacggcacccagttattcaatattattacaggctcggtagtcggaagtttcagttcctgtatacgatcaagtactggatgtttaagccaatcaaatattagtccttggaagtgggctatccggcgacgtatcgattctggttggtcaagccggttaatcactaactaggtcagtcgcatttaagattcgttggattgtggatgagtgttgttcacaaacacccattaaatgaaaggtcgatgatgaacttgttagttactaggcaacatcggattactttaaagtggttgttactgttagcgttcttttctgtattggttttagtccctacctcagcgtctgccagtgccaactggaaacaccttaatatgaattcattaggagctgccacaaagatgaaagttcttaaatacaattcacttaattggggtgagtattatgatgatcagagtgatttgtttaaagatactaagcatgtgcaatataagtacgccaaacgcacccgaacgctcatcatgcggtatcggaatccccagcagtttcttttaaaaactaagtataattatcggaagctgatttatcgacatggtcataaaaatccaattgtgacccattactttaaagtgggacacgaaaagtggaaatttgcaacgaccattcattattggctaaagaagccaatccgatattagttattaacggaacctcgaagctgatacttcggggctttcgttcctatggtttacctctcagtattattttaattatgtccccaaattgtttaattttaaacaatttggggacataattaaaatagcttgtctttaagaatcggtggcgtagttatttaaatctaatcttacgtgtgaatatccactgatttttaggaaattgggcgataatacaaaagcaccaactatattggaatagttggcgctcgcctgtgatttaatttaactcagtgaaatgcattggcttaagacgttaatcaaaaaagccaaaaatatctttaacggcagtcatagcttgtgctaattctgccgcattgacatgatcaacaatcttgccggatcgggcgatgtagtcataacccaaaagaccggttaaaataacatggccttctatcttatgagaagaaagtgtaatctgaaaaggtgccttaattttagttgcatgggtaattggaaagccgacaatcatacctgtccgttgattatatgctttatcactgacaaccagtaacggtctaaaagtattactggaatctggattatggccaccatattcatggcctgcatgcggttcactatcgatccagatgagatctccttgctgcgggatgtctttagtcattccaaatatcctctcgtccaaccggcgtgccattgtccccaatgttttcttcttccattgcttttcgaagatcgtagttcgagtctgcactataaatgttgtgtcgaactggtaacaaactgatcacgccgttttcatccttgattggttcaaactcaacgttttcccctatgttaaacgaagcaggaattgtcaccataatcgaattgccttgacgccgtgtttttacagtcattattaccaccctttctacacgtaattatatatgtaattacatttaaactcaagaaatttgtatcgattaaaattagaacgatctatttgttttgtacgttgaaaacatagactgggaggcttacacttataagcatgctaagtacatataataggaggaaaagatgaaagtaatcaagagcatcttcagctggatcctgccaattgccattggattggcactggcgttactactcaaagcctatattatttcaccagtcagagtggatggtgattcgatgatgcccaacctgcagaacaacgagcacgtggtcattttaaaaaccaagccaatcaaacgcttgtcagtggtagtgtttaatgcttacaaattggcaccggatacgcaaccgaacactgaatttgtcaaacgggtcattggcattccgggtgacaggattacctatactaagacggggcatttatatgtgaatggtaagtacatcaagcagccgttcatctcccgtcagcagcagaccactggtactttgagcaacgtcgacggtaatggttttaatttatcgattctttccaagaagtggcgcagaggtggacagactgctgtggttcccaagggtcagtattttgtgatgggtgataatcggaatatttcctatgacagccgttactggggatttgtgccaaagtcgcatatggaaggcgtcgtctacacattcccgtgggatgacaatcgaagtgaaattaataactatggataaagtaatgtccttcaccagttttagatctggcgaaggacatttttaggttctacaatatctgttcgcaattaaattctaaccgtaacgttttcggtcatttggcgaatagatagcgttctaaaaaaattctttgagaacgcctgaaatagtttggatgatcgttgtcgggacctgcccaactattttgccattagatcgtttctcgggatcaatggcccgaacatgttggagaagtgctgtcccatgaacttactctaagtcaatcttttgaaaaaacggtgaacgaataaatctttcttgtgtccggtacttatcagatgaactgataggtatgactaggacggtgttgagatgccgattatactcatcgttactaacaaccatacatggccgctctttctttgtttcagtccccttggcaggattaagattgataaacagtatatctccttgatgtaactccattaatcaaaatcctccgaaccggcatcttctccccaatccacttctggggtgacaatactcccatattttttttcttgctcatcaaccattttccagaaatcatccttttcgggagctgtccgttttacagtaatttggccatcagcacctaattcccattcaatcttatctgatgattttacatttaaggcctcacgaatggttttgggaatggtgacttggtttttggcggtgattttagaaatgaccgcaatgttatgatcatgttttgccataacactccctccttacttatccttacatatattataattcaaagaagttggtaaggcaaatgtaaggtacaccatgtgttgtggtatcagattgtaatcagtttttgaaatatattttaagatgtttgaccaagaacccatttgaattacttgccatttaattcacgaacttgatcaattaagccaagaaaatcattagccgcctggcgataatcttcaatctgatcaccgtatttttcgttaaagccttccaagccaccggcaacaaaggcatattcataatcatataccttgtcataagcagcggtgaacttcgtcaacaggtcgtggtgcttgccatccagctgcagtgccatttggacaactcgcacatccgtgtagccaagctcgaattgaatcgcccaagctcggatgaagtcgtgctgcgcctcgatgtgagcaaagtggtgctgggtattccaagttaatcgatctaatgatttgataacgtctaacatgtcattacctcccctaatcagtaatcatcatatttagttcatgttcattgaaccgcgtttggcgggggagggcaagtgattcgacttggaaatatcaaagagaaaaacgccttaaagtatgttataacagatatgtgataaaaatcacaaaattgtttctttggggagatcttatgatgcaatgcattcgtatttcggcagtctttcttagctttggactgctaacaactttcttattacagattatccaattggtatcgaatttttatacggtggacagtgcaaccgatgagccaatcaactattgggcaagcagcatgattcttgttccgttagcctttggagctctttttattatcacgttcgcattgggcttgtaccagatttatcaagagaaaaaacaaagtaaaaaaagtaaaaagtgaagaaacacaaataagcacccttagagcattgagcctccgagggtgcttgttattttttaagagattttatttaatcaattgtggctgaaacacacccataacggtatcctgggcagtgaacacaggaacctggtgactaagggctttggcaaccagctgcttttgatcagtggtttcatcctctgaactcagagcaaaggcgaggttgcttggccattgcattccttcgtggtaggtttgaatgccaaagccgctgccctttagttgctcgactaagctggcgttgttggcatcaaatgctgacaggagcacatcaccagttaggtgattggtatcaatgtggtagctgtcaaacagggcattgtgcaaggcttcctgcaggttgccgccggcgccgatgtcttcgccggttgacttcatttctggactcaatgcggttggggcacctggtaacttcgcgaaggagaagactggtgctttgacataaaccttggttggttctgggtgtaaccccggcttcaaaccaatttcagccagtgatttgcctaaaataagctgagttgccaattgtgccaaatgtagtttgacaatcttactcatgaacggcacggttctggatgcacgtgggttgacttcgatgatgtacacttcgtcagcgacgatgaattgaatgttcatcatgccaaccgcatgaacctgcttaccaatcttggtagcgatagcaacgatcttttctttctgatcgtcagtcaacgtctgtggtggatacatggcaatcgagtcgcctgaatgaataccggcaccttcaagatgctccatgatcccagggacaaagacgtcattgccgtcgcttaggatatcaacttcacactcagttccagggatgtactggtcgattaagattggttcaccatgactgttcttgagcgccgggatgagatattcgtttagttcgtcatcattatggacaacggccatccctttgccaccaagaacgaagcttggacgtaccaataccgggtaacccaggtggttggcaatttctaatgcttcaggggcatcggtagcggtagcaccctttggatgagcaatgttttggtcaattaagaggtcttcaaattgatgacgatcttcagtttgctcaatgccgtgaagggaagtgccaaggatggaaaccccatgcttggtcaagccttcggtcaagttgatggcagtttgaccaccaaattcaacgatgaccccaatcggctgttccaaattgatgatattcatgacgctgtcaatggttagcggttcaaagtagagcttatcagaaatggagaaatcagttgaaactgtttctggattattgttaataataatggcattgtaacccgctgcttgaatcgctttgacacagtggacagtggcgtagtcaaattcaaccccttgaccaattcggattgggccggcaccgataacgacgatactattccccagtggcttgctttcgttttcgttaccaactgtactatagtagtaaggcgttgtgctttcgaattctgcggcacaggtatcaaccatcttataaaccagatgttgatctgacattttgtctaatttggtcaactcatcgtcggttgcgtgatgaatggcttgaatcatggtgttgttgaagcttaatttacgggcttttaagacttcatcagcactcaagaggccatcggtcatctgttgctgcatcttgatgatgttttccagtttcgataagaagtacatatcgatttgagttgaacgattaatctgttgaatggtagcacccttaccaatggcggcaaagatttcaaataatcgataatcggttggcgtcttaatcttttccagcaagtcgcccattgacatgtttcgggtataagccggaatcaggtcagtttgcgcttgttggtcgagttccaatgattgaacggcctttaacagtgattcttcaatggtactgccgattgccatgacttctccggtggctttcatttgggttcccagtttgcggtctgcgtttgtgaatttgtcaaacgcaaagcgtggaatcttagcaacgacgtaatcgagcgccggttcgaacatcgcgaacgtggtttgcgttattgggttcatgatttcgtccaggttcaaaccaactgcgattttggccgcaattttggcgattgggtagccagttgcttttgaggccaaagctgaggaacggctgacccgtgggttgacttcgatgacgtagtaagcttcactgtttggatcttgggccaattgaacattgcagccgccttcgatcttgagggcgttcacgatggtcaatgatgcgtcacgcagacgttgatattctttgtcggtcaatgtctgagttggggcaaagacaattgaatcaccggtgtggatgccgactggatcgaagttttccattccagtcacgatgattgaactgccgtggtgatcgcgcattacttcaaattcgatttctttgaagccggcgatactcttttcaactaaacattcagttgagggtgacatggtgaggccacggttcaaaatggtggtcatttcatcgtcgttatgggcaattccgccgcctgttccacccaaagtataggcaggacgaataatgacggggtagtcgatcttgtgagcgaagtccaatccatcttggaggtcgtaaactgttttggaatcaggaattggctggtaaagctcttccatcaagtctttgaatttctcacgatcttcagcttcgttgatggtttgcaaactggttcctaataattcgattcccagttcatctaagataccgtccttgctgagttcaacggccaggttcagaccggtttggccgcccaaagtcggcaagatagcgtctggatgttctttgttgataatcttcttcaggcttggaacggttaatggttccaagtagaccttgtcagcaatttcatcatcagtcatgatcgtggcagggttggagttaaccaaaatcactgagtagccttcttcacggaggctgaggcaagcttggctgccggcatagtcaaattctgcggcttggccaatcacgattggacctgagccgataattaatacttttttaatatcttctctttttggcattaatgaacccctccgtttacgtgcattatttcgataaagtcgtcaaataatttggtggcatcgtgtggacctggtgcggcttctggatggtattgaactgagaataccgggcggccgggatagcgcaggccctcacacgttttgtcgttgacttcaagcgcagttacttccagtggggtgtctttaacggagtcgacgtccactgcgtaaccatggttttgtgaggtgatgtaaatgtcaccagtgatcaggttcttaaccggatgattaatcccacgatgaccaaacgtcattttgtaagtggtggcgccgttggccagtgccagaagttgatggccgagacagattccaaacagcgggaagttgtcctggagcttttgaatcaccggcacaaagtctgagtaatcggttggatctccaggaccattggataataggatgccggttggatgtaagttggcaatatcttcaaacgttgattcaggcgtaacgacggtcacatcaacgcctgggcgctggagtgacttgacgatgttatctttgacaccaaagtcaacaacgacaacatgttcaacatctttggcgtcgcctgcggacaatgtggctgatttgataatggatgccgagcggtcagcttttggttgatcaacgattgggtgattggtaaggctggccttcattgtgccatagcggcgaataatcttggttaactgtcgggtatcaatcccgctgattgctggaaccttcgactgctttaggaaagcatcgaggctgataacgctttggtaatgaaatacttgatcggtcatttctttgacaacgactgctgctgcttgaacggtgtccgattggttggtgcccagtgagatgccatagttaccaatcaacggataggtgaaactgatgatttgatgtttgtacgatggatcggtcaatgtttcctggtagccggtcatgctggtggtaaagacgagttcaccatcaatttcggcgcccaagtcaccacacgcttccccgacgaagacatcgccgttttctagagttagatactttttcatgtccgaacctcctcaatttgttcctaacaatgctgcggtatttacagttaacgcttttgaatatttaagatagaagtatttagggcaaatgtcaagtgaaaatatgcaatatttgccgatattcggataaatatgtacaaataaaaaacactatgtatatttattaaatatgccccaatgcctcgaaatcgcgtccttatagataagttagtcgtcactttttaatatattcgaattgttggataaataaacattttcaaaattaatttcacaaatagacttgttttttctctcaaaatagaatatgattctaagtaatcaaacagaacctttaacattaaccccgtgaggttaagaaggtatggcgaatcttgaggagactcagggctaactcaaacctctttaccgaacgcggtaaagaggttttttgttacatatctactaattcttattgacgatttaactgttcccgtgagagcaaaacgtcctggaatgtggttcccgacacataaggagcgctttgcgaacacggcaaggcgcttttaattttaggaggaaatcacaatgatgcagattactaaaccggtaagttttgaaaatgttgtaagtatggaagatctttcagccgaagatgttttatcatttatccatgaagcacaggatttcaaagccggcaagcagattgagctaaaacggccggtatacgccgctaaccttttctttgaaagcagcacaagaacccacaccagttttgaaatggcagaacgcaaattgggccttcaagttgtcaactttgatccttcaaacagttctttgagcaagggtgaatcaatgagtgacactgttaagactttccaagcaatcggcgtagacttggttgccatccgtgataagaagaatgaatactacaaagatttaatcgctgatccaaatgtccacgttggcattgccaacggtggtgacggttcaggtcaacatccatcacaatcattgcttgacatgatgactatatatgaagagtttggtcattttgaaggtttgaaagttgccattgttggtgacttaacccactcgcgagttgcccgctccaatatggaagtcttaaccatgcttggcgcccacgtctactttggcggaccaaagaagtggtacaccgaagaatttgccaagtacggcgaatggatgccaattgatgatttggttgaagaaatggacgttatgatgttcctccgtgttcaacacgaacgaatcgctgacgacgaaaatggcgccttctccgctgaaaagtaccatgcccaatatggtttgactgcagaacgtgaatcaagaatgccacaacattcaatcatcatgcatccagctcccgttaaccgcggagttgaaattgccgacgaattggttgaatgcgacaaatcccgcatctttgaacaaatgcacaatggtgtgtttgtcagaatggcaatcatgaccagcatgcttcgcaaccgtgacctcattaaggaagaatattaatagcgaggagaatttcgactgatgaaacgcatcattgcaaacggacaaatactggatcgtggccaattagttaaacgcgatattttaattgagaatggtagggtagctaagattgctgaagacatttcaactgatggagtggatgaagtgatcgatgccaaggggaactttgtctcggccggcttaatcgacgtccacgtccattatcgccagccgggtcaggaacaaaaagagaccattaaaactggtagtctggcagctgctcatggtgggttcaccactgtttgtgcgatgcccaatgtcaccccggcacctgactcagttagtgatatggaagctttaattaaattgaaccacactgacggtgccgttcacatcaagcaatatgcgacgattaccaccaaccgtggtggtgatgagttggttgatttcaaggcgttaaaggatgccggagcctttgcttttagcaacgacggcaatggcattcaaaagagcagtaccatgtatgaagcgatgcagcaggctgccaagctggacatggccattgttgaacacgttcaagatgatgccttgacatacggcggtgttttgaacggcggggccgctaaacgtctgggaatgaaagaaatgccttgggtcagtgagacggcccaagttgcccgagacgtcattcttgccgaagcaaccggcgttcattaccatgtctgccacgcatcatccaaacatactgtcaacgttatccgggctgccaaacaagccgggattaacgttaccgcggaagtttcaccgcaccatctgcttttgtcggacgccaacattaaagaagacaacgcgatgtacaaaatgaatccacctttgcgaggagaggatgatcgtcaggcattgatcgaaggcctgcttgatggcaccattgatatgattgctaccgaccacgcccctcacaccaaggcggataaggatcaatcaatcgccacagctgcctttggcattaccggcagtgaaacagcattcagtatgctatacaccagatttgtgaagaccggtcggttcacgttggcccaattggttaattggctgaccaagcagccggcatccgtcttcaaaatgagaggcgccggctcactggcagtcggccagcctgctgacattgccatctttgatttggaacacgaacacgaaatcaaagaaagcgactatttgtcaaaaggcaagaattcaccatttactggcgaaacggtctatggcgatacggtcatgaccttggttgatggtgacattgcctacaagagatcgtaaattaatcacataaaaacatattggtatcaataagaataaaaagctgcagttcaccgagactcctaactcgatgaactgcagcttttgtattatttgagaaacatcgtgtaatagccgattgctgaaaccgcttgggcggtgttgactttaccttcgcggatccaatcgacgacttgttgaagtggcactaattgactgttgacgaactcatcttgatcaaagtggcgttccacgcgttcgctaggatcaaatttaatcaacattaggtcggcaaattggtccatgaagccttccgaagaagtgattcgagtcatcttagtgactgattgggcaacgtagccggtttcttcccgcaattcgcgggcagcagcctgttcactggtttcacctggattcactatgccagctggtaaggaaaccgaatcgctgttaacgccagcccggtattcgctgctcatcacaacttgatcagccggtgaaattgccaggatggtgatggtcgggtcggttttaatcagatcgcgctcaattttgagaccgtccggtgtctggatgtgtagttgatcgacggcaaagacgcgaccagtgtagacgtttttctggtcgaggatcttgccggggtggtgccatgttttgaacaaacaattatctccttttgatgacttttctttcatatcggtcaggaaggctgatgtgaaaagccgattcattacagcaattattttatcatcatttagacgcccatcaaggctgaaggagcactcaacttgtcatcttaatcccaacaatgcttaccagcagcagaatcacaaaaccccaagtaatcggagaaatcttgtcgccaaacagaataatgccggcgatcactgttccaacggctccaatccctgtccatactggataggcaatgctcagcggtaatgttttcgtggcatgtgctaacaggaagaaactgatcagcatgccgacaatggtgacaatcgatggcatcaagttggtaaacccgtggctatatttcatcgccgttgcccaaaccacctcaaagatgcctgctataatcaaaaatacccaattcataaaaatcctcctaaagaaaaagggtacccctcacaattccttctatgacctaacggaattgtaaaaagtacctaaagttgctgcccggtggcagtcgaatatcaagttgttattagtgtagcacatttgaaatcgaaagggaatttacttctttatgccaaacttctcttccaatgctttcgttagtaactgggaaaagtttaggtttgattcaattcctttttcattcaaataatttggaatgttgacggttttcttgacaggatgggaatcatgttggcgacgataagcactgatattcacatctaccaaagtggccaattcatttggcttagtgtctggaagactataaactgattttggcacagaacctccgtcttcaatcagatctaatacttttagaccaataaaatctcggcccatttcaatggagttttcaatggatgtaccttgtgtatatccgcctaaatttggaatactaacaatatacggaaccgatttatcgttgggatcttttataataatgattggatagactactttgacatctttcataatgacctccaaatattgatttaacgtaattgatgtttccttattagatctcgagcaagccattcattaatatttggatgccgtggaataacttccttttctttaccgtttgtccaaatatcatgatttccaccatggcgatataaataccaaccatgccgttcgaagagctgcaacaaacgcttccgcttcatcgaagataatcctcaactttctgtatattttatacgtgcattgtacgtagatcaagtaatttgtatttcctcaaagcacttttttgaaggtgacaaattcgatgacttacataattaattacgtataaatacaagaaaggattttaaaacaaaaaatggatgacatccgccatccacaaaattcaacaattcaactacttttgcagcacccggaccctaaacaccgcgtcaatcttcgaaagacggtcaaccaattggtgttcttcctcgttgttcaagttatccaggtcaacaatcgtgtaggcgacgtcttttctggccgcgttgctcatactttcaatgttgatgcccgcatctgccaacagggtggcgatttggccgaccatgttggggatgtttttatggatcaacgttaagcggtaaggggtgttaaacggcacttggaggttggggagattcacggaattttcaatgtttccagtctccaaatatgtcatgatcgtattagctccctgagtggcgccgttggcttcagcttcgagtgtcgatccgccgatatgtggagtgaccaccacatcgtctcggttcaacaggatattttcaccaaagtcggtatagtatgtccgaattttgcgcgcgtccagatagtccacggccgcctcgttgtcgacgatcccgtcgcgagaatagttaaatagtttgacgccatccttcataatggccatttgttcagggccgatcagtccggtcgtctcttcattcttcgggacatggacggtgacataatcggcttgctgaagggcttctcccagcgtggttgcccgagtgatggttgtcgaaatgtgccaagcggcatcggctgacagatatggatcgtaaccaatcactttcatccccaaagcgctggcggcattggcaaccagggagccgacgtggccaaccccgatcactgccaaggttcggccggtcaattcggttcctttgaacttggtcttgtctttttcagttcgcagcgaaatgtccgcgccactattgtgggcagcgtaatcggctgcagcaaacaagtttcgagatgaggccaccagtaacgcgatgatcagttctttaacggcgttggcgttgctgccgggggtgttgaagactgcggttccgttggcagttgccttgtccaatggaatgttgttaaacccagcgccggctctggcgatcacctttaatttcttgggaaagtcctgatcatgaaggttaaccgatcgaatcagataggcatccgcatcatcagttttgttaatttggtagttgtcggagaagcggtctaatccagcttgtgcaattgcattgtaagtttttacttgatacatatgagttccccctaatgttgtttttcaaagttgtgtaagaaatcaaccagtgcctggacgcctgccagcggcatcgcgttatacagacttgctcgcagaccaccaacacttcggtgacccttgagattcatcaaaccggcttccgtggctgctgtaatcgcctgggtatctagatcggcatcaccagtggtaaatggaatgttggtcaacgaacggtcagaggccttgatgtggttggcaaataattttgagtcgtctaagaagtcgtagagcagggatgccttttgccggtttaccttctcaatttcagcaattccaccttgatccttcagccatttcaataccaatccggtggcataaatgttgaaaaccggtggggtattatacatcgagttctttttgacgaataaattgtaattgagaatgcttggaatatggtcgactgtctgaaccagatcatctcggacgatgaccaaggtcaccccggctgggccgagattcttttggacgccgccgaagattaagccaaagtcattgacgttgtattgttctgccatgaaattggaagataaatcaccaaccaaggtcacatcgccgtgttcgggcagctgatgataagcggtgccttcaatggtgttattcgtcgtgatgtgtaaataatcataatcattggcggagattcgctggttcagttgtggcagtgcttgataatgctgatctttggttgaagccaacacattaacttggtagccgaggttagctgcttcatcaccagcccgggtagcccaatgaccactgtccagtaaggcaatcttcttgtgcttggttgccaggttcatcggaacggcggcaaattgacccgtgccacctccttgaaagaagaggatgtgatagttatcgggaacgtccatcaagtctctgacatcctgttctgctgcattgataatgtcgtcaaacattttggaacgatgggaaatttccataatactcattccactgccgttgattgatggcagttcagcttgaatctgtttgataaccggatcaggaagcgttgccggacccgccgcaaaattgtataccgtcatgaccaaaaactcctttatataaaattaaaaagctcccacaggtttgctgtgagagcttctaactgacgtttttagcggtctcacagtgatgaaaaagatttcatctatgcaaggccttttgttgaatcgcacgtatcaaaagatggcctacatagatgtgactgtagaccaggaggatgatgtagttgtcgttaaatcagctaattgcatgttcatgtgaacaacctccatttcttataactaaaatctaacagaactcacagataaaagcaacacccattttgaagaaagtgtcacggaactgtttgcatgtgcttgaagatcatggtaaattcaatggataattaatttattgggaggaacgcgcatgactgatttttactttgttcgccatggccagacggctgccaacgccgccggattaaagcagggcaccattaactctgaaattacctacctatcagaaaccggaaagcaacaggtggaaagtttgcggaaaggtttcgatatttcgtttgcggatagaatcattgtcagccaactgcagcggacaaaagacacggcggccattttaaatcagagcgcgaacttaccggtaacctatgacaaacgactcctcgaaatttcatatggcgactgggatggtgagaagaacgctgatttgatgagcaaatatcccaaactttttgacttcactctaaatgacgttcttcctgcctacgcagatgtggcacatggtgaaactttcgatcacgtcatcgatcgcgtcgctgaattgatgcaggaaactgcaactaattatcctaatgacaagattatcctggtcactcacgggtttacgatcaaagcggctgtgttggcagccatcggtcgtcccaaggacatgatggtgattgaggagccggataacaccagtgtgacccggatcactttacagaccacaacccactcgtattatctgcggtattacaaccgggttgtcaattctcagttttaaagtgattgacaaatgaaagtcaattggttatattaaatggcatcaagtaacgaaagaggaggaagccattcatgcaaatgtcagctgctaatatgatgtgttgttcaatgtgtcaagctcaacttagcgctgatcgtggcttctttggtaaacgattggatttttgggacaagctgtgagctgatagttgacggcccattttctcaagaattaccaatgccaagagtgtctcatttcagcgtcaaagctggagtggggcactctttttgtataccagaggatctcttttgttgaataaataatcttaaaggtggcggttgcagtgtgtagtcagatgttgattgaagtgaaaaggacaaactaaattctttggaggaatcattcatgcgaaaactcagatcacttttattattagccttgagcgccattctggtagtgactttggcggcttgtggcaaaaccgcaaccaaatccaacagtcaaaaacagacattgaatctcagcacgacggccccgttggatacgatcgacatttcaaaatccaccgggtatggccagaccgggaacgtgtttgaaagcttttatcgcttggggaaagacggcaaaccaactgctggcttggctaagagcggtaaggtttccaaagatggtaagacgtggacctttaccttgcgcaacgctaaatggagcaatggcgacccaatcactgcccaggattttgtctactcgtggcgccgaaccctgaaaccaagcaccaaatcgacttacgcctatttattcagcggaattaaaaacgccgatcaggttaacgccggcaagctctcaccaaacaaaatcggtatcaaagcactgaataacaagacggttcaaatccaacttgagaaaccgattgcttacttcaaggtcctgatggcctatccattatttggaccgcaaaaccagaaaattgttgataaatacggcaaaaaatatggtaccaactccaagtacatggtgtactccggaccattcaaaattcaaaactggaacggcaccggcaataagtggcagttcgttaagaataaccgttactgggataaacaggccgttaagctccacaagattaactataccgtggtcagcagcccgacgactggccttgagttgtatcagcaaaacaagctggatttgacgccgctttctaatgaacaagtgaaacattacaaaggcaacaaggaatttcagcagtatccatattcattcatcggttacttgaagtacaacttcaaagacgccaaccaaaccaaacgcaaagccatgagcaacaaggacattcgtctcgcaatttcactagccattgatcgccaacagctgaccaaaaaggttcttggtgatgggtcagacacaccaactggctttgtggcctccggattggctaagaatccgaagactggcgaagactttgccaaagaacagactgttccaaatacggtggattacaacgtcaagttagccaagcagcattggcagaaaggtttgaaagcccttggtaccaagaaggttaccctgacaatcactgcttccaacgatgatccaaccagcaacccgattacacagtacatgaagtctgaattgcagcgggacttgcctggatttaagctcgatattcgaaatgtgccgagccaagttgccaatcaagaagtcttaaagggtgactttgacctgtcattatcgggttggggtgcagatttcaacgatccaatttccttcctgcagatcccggaaaccggcaccgcatacaacagcggcaagtacagcaacccggcatatgataagctgattaaacaagctcaaaatcaggatgccaataacgctgacaaacgctgggatgatttggttaaggcagctaaattgtttaatgctgatcaggggatgacgccactgtaccagcaagtcacctcgtatctgcaaaagcccgacttaaagggtgttattcataacactgccggtactcagtggagttacaagtacgcctatatgaagtaaacagccaaggtctaatgcctgcggccactcgttgtcatctcattaacttaaattaaaatgagaatccattgaccattgagagcgatatcatggtacacttttctcaactaaaacttttgaggtgattaaggatgacaagaaaaattggtgttatcggaatgggacacgttggctcaacagcagcgcattacattgtcgcaaacggcttcgcggatgatttggtattgatcgatatcaatgaagataaagtgaaggctgacgcaattgattttgaagatgcaatgtccaacctgcccgtccacaccaacattactgtaaatgattattctgcactgaaggatgccgatgtcattatttctgcattgggaaatatcaaacttcaggacaatccgaatgacgatcggtttgccgagctgccattcaccagcaaggcagtcaaatcggtggcacaaaagattaaagactccggcttcaatgggatcattgtcgccattaccaatccggtggatgtcatcacttcgatttaccagcaaattaccggtctaccgaagaaacacgtgattggcactgggactttgctggattcctcacgaatgaagcgggcggtggctgacgaacttaatttggatccacggtcagttaccggatttaatttgggtgaacatgggaactcccaattcactgcctggtcaaccgttcgggtactgagtcatccaattaccgagattgctaaagaacgcggcttggaccttgatgcgctggacaaagctgccagagaaggcgggttcaacgtcttccacggtaaaaagtacaccaactatggtgtcgccaccgcggctgttcgtttagccaacacggtgatgagcgatgcccacactgaactggcagtttccaactaccgtgaagaactcggcacctacttgtcatacccagcggttgtcggtcgtgatggcatcattgaacaggttcaactgaagttgactgacgacgaaaagaagaagctgcagatttcagctgattatattaagacgaagtttaaggaatcaatggaaaactagaacagattgggactaaaggcgctttgatcccggcccgattgcgttatatggccgggatcagccgtttgtaccaagttttatcattataaaattggtgattgtagttgcaatgaaaatcaccgtaacgattagtggtccaacctctgttttgggacaaaaaaataacctccagcaattaagaactgaaggctttaagcaatttatctaactcgaattgttaatatacttatattataacgcgacgaattcgatctgtcaacgttgcctgcaaaagatattcgagtttgactggctggcagattcagcctaaaattaagccaataaatcacgattggagcaatcaattttggcaaactacgaagcagtgtttcatccagacggttacaattctcctgagtaccgcagcttaaattattcctatcagaataaaatggccgaattattctcccaccgacggattgattatccggccaaagaacttcaatttgaaattgaaaccgtcaaaatctccagtaccatgactcagcggcaatacctcaaacttcagagcttggtggaatcatttcctgaaactcaacgcagtggagctgcccccgtcattggcaaggacgattaccagagtattattttgtatcatgactaccgattatttgattcgacccagtatgttgtccgcagtccggtgggatttggctataccgtcagcaagttgatcacgattacgagtgagccagcgggaggtcctcatcaccaggtgaaggtgacgttggcaattaacccgaatcgtttcgttgacgttcccgaagaacctttgcttcgcctggtcatcgaagaggtgttgccgctgatggtaaccccacagatttctgaaatggatttaacgttagatatgccgctaatcatgaacaactttcatgttcagatgggtggccaagctgggacaaaacagcagattacccaacggcttaatgatcatcaagaatatgaattgagccgaattgcctatgtggatcctcagcagacccgaaaactgatcgtggcagacaagtttcaatccctgttggacaatcaattgctggtggcggatactgactacatttctgcgcgggaggccgaatactatcgggaccaagttggagaacggcagtttttaacccggattgaattggcggtcaccacccctaatgccgtcatgcggtacatgaagaatcacgagtggctgatgcgggacatttccatcgagtatcgtgataatagcggcatctcaagatttgcgggtaccgattacgcgaccaacgggaaggacttccgccgctcatttaaccggatgctgacgtatcggctgaaggaagttcagcgacgagcacgcaaactgccatatctgactgatgcgatttggcggaataccctgaaatagaatttgaataaatctcattaaatgaaaattcgctgttgaactgacatctcaaagtggtatgctgttaccattaaaaatttttgaggtgattgaatgacaagaaaaattggtgttattggaatgggaagtgtgggctctacggtcgctcactatatcgtgtccggcggctttgcagacgacttggtactgatcgatataaatgagaaaaaggttaaagccgacgccttagacttcggagatgccatggccaacttaccgaatcatacgaacatcgccgtgaacgattatgatgaattggccgacgccgatatcgtgatttctgcgattggcaaactccagctgcaacgcgacaatcccagcaatgatcgcttcattgagtatccatatactcaaaaagcagccgcatcagttgccggtaagatcaaggattcaggctttaatgggattttaattgtgattaccaacccggttgacgcgatcacgtcaatttatcaggcggtcactggtttgcccaagaagcatgtcattggaaccgggacgttgttggattcgtcacggatgaaacgggctgttgccaagaaattacatatcgatccgcgttccgttgccggttataatttgggggaacacgggaattctcagttcaccgcttggtcaaccgtgcgggtcttaggcaaaccaattactgaattggctgacaaagaaggccttgaccttgataaaattgatgaagatgcccgaatgggtggcttcgtcgttttccgtggtaaaggatacaccaactacgcgattgccagtgctgccgttcgcctggccaacgttgtgttaaatgatgcgcgaactgaactgccggtatccaattatcgtgaagaactcggttcatatttgtcatacccagccattgttggtcgggatggcattatccaacaactccaacttgacttaacagatgaagaattagcgaaactgcaaaattgtgccaatatcattaaagagaagttcgaagaatcaagagccaaggactttgcggctgaatagggacttttcacatagaacaattttcatccacattcatatttgaggatcgtcacgcctcatagtaatggccaggtcaaaatcagcaacttttgacctggctttttgtatcccaggaggtcactggattaccaattcatgatttttagcgctcttttacatgtttctcccacttttggtatatattaagattaatcgagggggaaaaatgatgaaaaaagaacgggtggaagcttttacggatgccgttttggcaattattttgacgattatgattttggagttcaagaccccggaatcgtttgcgattagtgacattttagatcaagtgccatacctgatttcctacgcaattgggtatttgttcatcggcgttgcctggtacaatcaccattacatgttcgccaagaccaattggatcacgcaaaatgtgtattgggcgaacaacttgtggatgtttaccacgtcctttgtccctgtggcgacggcttgggtcgggcgcgggttaaatgaacaggggccggaaatcttttacttcgttgtctttttagcatggtcgagtgcttattattatctgtccaaccgattaatcaaggccaacgaaaaagaccaccgaccgaaggcggcggaggcgattcgatcgatggtgatttatcgatatatgagtaattggaaactggtgggcgggcaactcattttgtcagttattgttttaaaattcatgccggcgcttcaaatggtcattgtcacgttaatgattatttttatcggtgcccggtttaacgcggacagcgatcggctctttcgctagtgggcaatcagggtgtagatgaagtagccgagaaagccgacgcacaagctgagtgagccaaaaatcatgatctgaacagaacagacaaaagtcttggttttaatttgttcatggttgaaaatcagggactgcttgatgatcagtggaactgccagtagaatcgagaacagtgccaatgggaagacgccaacgtacatggcgtaaaacaccagcagaaccgctaaaacgttggcggtattgaacattagcagggaattcttcttgccgatgtagtggacgatggtccaacggtggttgacctcgtcttcttgatcatcgcaaatgttattggctaacataatgttggcaatccagaagaacaacggtgacgaagccagcagaatctggccaagcagcgaggcattccaagtgaagagctgataggaattaacgtagaccgagatcagggtaatcatgatccccatagcgaagccggatgccacttcaccatacggcgtgctggagatgggatgtggaccggatgaatacataattccgatggcaaaacagatcaatcccatccacaacagcggcaggccgactttgaataccaggaaaataccaatcaaagctgatggcacaaccataatgacgatcataaaacgaatgaggtttaaagagatgtggtcccgaccgatgatgttggtaccggttttccattcctcagcggttgaatgcatgtagtcgttatagttgtccaaggtgtccacggtcatattgaacagaatcatggcaatgaaaaaaagcgtagcgtaaagcccattcaccgagtcgagcaggtaccagctgaaaaacagtccggtaaaaaacggaaagatgctggcagctttggctcgcaactcgacgagctgggaaaaagttgataaactcatgatgacctccaagataaatttaaaataatttcaaaaacatagtctaattataccaaaggagcgggaaaatgacgctgacgaacaagacgccggaaacaaaagttgaatcattatttgatcaaattgcggacaactatgatgggatgaactcgctgattagtttggggaatcataagcactggcgaaagttggtcatgcagcagctcaacgttgaaccggggagctttgcgattgatgtttgctgcgggaccggggattggacaattgctttggccaaggcagtcgggccctccggacaagttgttggcctcgactttagtgaagagatgctgaaacttgctgacaagaaggttcgtgcagccggcctgcaggatcgggtaaccttggttaaaggggatgcgatgcagctgccatatgatgacaaccactttgacatcgccacgattggcttcggtctcagaaatgttccggatgctgaccaggtgctccatgaaatgagccgggtggtgcacgcccgggggcaggttgcctgcctggaaacgtccaagccaaccaatccggttatcaaattcggctggcgggtttactttgatttggtcccattaatggcaaaagtggccgtcaataaatatcaggagtacgcctatttacaaaaaaccactgccgaatttgtctcggcgcaacagttggtggaaatgtttcaaaacgccggcctggttgacgttcactatcgtccattcacttttggggccgctgcttttcactggggaatgaagccctgacaaaatttcccttgattcacaagattaaaaacgttatcatgtgtttaacatattctaaggagtttttaattatgacagataatttaaacatccaaatgaatagttgccgatattacttttggtttttccgagtgtgatctgtggataagccaaaagcatttcgtaatgcatactaaaggccgcacagatcactgagttgactgtgcgggattataccattggtgggtcctcacagtcagttcgttgactttgaggacccactttttaggaggagaacacaatgagtaaattatcagataagatgaacaaacgagtagctgcgttaacgcctgccgcaattttgactttcaaccagaagatttcagcgattccagacatcgtcaaattaaccttgggtgagcctgatttcaacactccggaacacgttaagcaggccgctattaaggcaattgacgataacgaaagtcactacaccaactcccgggggacagaaggactccgtcaggcagctgcgaacttcttgaacacgaaatacggtctgaattacgatcctgacaaacaagttatcatgactgaaggggcaactggcgccatctactcggcattgactgccatgatcaaccctggcgacaccgtgatcgtcccaacaccaattttcccactctacgtgccgatcttaatgctggccggtgccaaaccaatttttgtggacacctcggataatggctttgtgctgtcaccggaaaaattgtctgcagcgattgaggctaataaagatactgttaaagcggtgatcctcaatttccctaacaacccgaccggggttacctaccacaaagacgatttacagaagttggcggacgtcatttccaagcacgacattatttgtttaagtgatgaaatttacagtgagttgacctatgacggcacccacgtttcgatggggtcgatcctgccggaacaaacccttgtcatgaacggtgtttccaagtctcacgccatgactggctggagagtcgggatgatctgtgggcccgaagatatcatcaatgaaatcgccaaggtcagtgaatttacgatcacgtcactgaccaccaacgcccaggctgccgccgaagaagcattcaagaacggtatggacgatgccctgccaatgaagaaggagtacatgaagcgccgcgacttgctagttgctggtttggaaaaagccggcttcagctgtcctaatccaaatggcgccttctatgttttcgccaaaattccagctggtttaaaccagaatagtgaagcattctgttatgacttggccaaggaagccaaagttgccttaattccaggttcgtacttcctgccaggcggcgaaggctacgtccgaatcagttacgcagtcagcgaggaaaatattcaagaggccgttagccgcattcaaaaatacgttgaaaaacagtcagtcaaataaagggagcttgagttattttgaaaattttaatgtacaatgttcgaccagacgaacaaaaaccactggatggctgggttaagcaaaacggtgtccaggtagataccaactcggtaccgttaaacgctgaaacagttgaccttgccaaaggttacgacggcattgtgattcagcagcacggaccagtctcagatccgacaatttacgagaaactccatttatttgggatcaagcagattaccttgcggatcaccgggtatgaaatcattgatttggaccaggctaagcaaaacgacttggtcgttaccaacgtgccggcctactcaccacggtctgtcagcgaactggtcttggccgatgtcatgagcctgcttcgacacatcggtgaagtgggtgaacgcgaaaagcacggcgacttcagctggaagggtgtcgaagcacgtgaaattcatactttaacggttggcattattggtgccggcaaaatcggcagcgcggttgcccgaatttttagagcgctgggtgccacggtgattgccgctgatccgattcatcgaccagaactcaacgacacgttgacatacgttgatcacgaaacggtcttcaaaacagctgatatcgtgaccatgcataccccattgactgacgagaccaaccagatgattaacgccgacgtcttcaagaagatgaagccctccgcaatttttatcaatgcttcccggggccaagtggtggataccggcgctttggtgaacgccttggaggaccaggaaatttccgccgccgcaattgatacctttgaaggcgagaatacgattgtcggccaagatttaaccggcaaaccaattgataacgataatttaaagaagttactggcaatgcccaacgtcaacgtgacgccacacattggtttctataccgaagtggccgtccaaaatatggttgagattgctttgaatgacgttatgatgattttgaatgggcaaaagagccctcatgaggtaggcgaatagatgaatttaacagcagaaccatcagcacggctgaacggtcgtgagctcattatgaatacgttaaacgggctgtcggttgggatcattgttgcactggtccccggcgccttgcttaatcaattgttgaaggctttgctgccagtatttccacaagctgctttcttcttgactttgactggaatggcggccgttttaatggcaccgattagtgcggtctgtgtcgggatgatggcgggctttggctttgccggcttgatcggaccaatcgctgcagttaatggttatggcaatgccaatctgatgaatattgtcttggttagcttacttttcttggtgattccggttacgcttggatatgttagcaattacttattcaactccaagctgagttattttgacgcccaagattttgagttggattattcataaggagtcgagaatttgggaactgaatttgccgtgctagtcctattaatctttgttggcggtgcgatttactactattacttcagtaaacaagagccttcaatgattgtggggtatcggacaaaacaaagtcgcagcacaacggcaaagtggcgggcctcacagaagtggttctaccaaggggcaatcacttgtgccgcggttgttgtggtggttaatctggtaacgccattttcgattggtgtgaatttggttgttttgttagtttatttatttgtgattagttatttcatcgagcgtcgcttgcgtgagatgggagattagaatgaaaaaggcccgctgagttggcgggcttttttgtgttttagttatttgtttgttggggttagtggttttagttggggggatttgttgttttggtgattcccttttatctagcggaaacgtgctccgatgaccctgacccctaaaatgtaaaacaaggattgtatcgatgaacaaatgtctttaataatccaaccttttgaccagttcacaccaattaggccttcctgctccgcagtcggtggcgcccaattagtggcaccctgtgccatctcaaacccggttactttaatataatttcggccaggccggtcaggataaaagcaatatcttcgaacgctgatttcaactagttggtcgtcaacgttaagcccatggaaatcagataaataatcgtctgattgtcattgacttttgcataccacttatcctcttcttccctggtggtagtcctgtgtacaagcttttgcgtaatatattctcgcgtttttgtgggcccagtccccatcaccagctcattataatccgccgcctcaaataacgctttcccgttgacgtagactgccccagcgtgacgcccattactttgttccagccaatcaccttttaaagaaaaggcaaacgggttgaagtttccaaatacatggttatcaattaccattctccagataccgttttccattttatcaatgtgatcaacaacttctgatcccttgattgtaacatgatcacctgtagccgcctgatatgccaccatctcaccaagtcgaccccctcgagcaggattcacccgttcacgataagtcccttcatggacgataactgaatctcctgggcctgccaattgggcggcatgattaatcgttagtaacggtgaacttttttgcccatcgttttgatcagacccatttttagcaacatgaaatattgtcatctgcaactccttctctcgtccagtatcaactgcaaacgggatgcctaccttcattgtaaaattgcaaaaaacctgattatctgctataaatgaaacaataactgtcatagcaaagaaggcgatcttttggttttatttcaacattttggacttgaatcctcaccaatctttaaacactttgacatatccgacttaaactaccccattcatcttcaccgtgccttcgaaatcttatatgttcgtaaaggccaagttcaagagcaagtcgacaaccgcatctatcacgttaatccccatcaatttatcattgtttttcccgatcagctccacggcttcgacatgtcaccaaataccacagcaagaattattttgttttcgccagaaattgttagcgcattcagtgaacaatataaggatcatattgcagacaacccagtcattttcgataatgttccgccagaatttgagcatttggacaatatttttgggatcaagagctttttatacgggctttgcaataaggtggtggaacagacccagctaacgctaaaaaagacttcttctcaattgacgacaatctaccaaattattaactacattaatgaccattacacagaatcatgcacactcaagcaaattgctgactcaatcggctatgactatgtatacttatccaaactctttcagaaaacaatcaacctttcgtatactaaatacctcaacagttttcgtatttccaaagcacgtgaactactaaagaacacttcattaccagttaccgacattgcctttaacgtgggctatgaaaatctaaggacctttaaccgtaatttcaaagacgtcaccgggaatacaccagcacagtatcgcaagtcatccaaagtgactaaatatgataaggcgatccaagagaattacatctctggataaatcaaaagttgacctttttggaagagtattctttcaatattggtcaactttttaaatatactgacctactacttgctcaagaaaatcactggccataatatattgttatttctgacttgtaaatgtcaaatcatactcatccatgtccaaaacccgatgtgtcaacagtgagcaacaccccaaaagcgttgcatagcctgaatgggggattagccgaatgggtatcttcatcccaagcttctgagcattatcaacgatatcgtcaaacaacgttggaatatcttcaatcaatggtgagttcaagtagagttcttggggggcaaaactaattgcaacattataaataacccgcgaaattgcataagtaaaatgtttaagttcactttgaacaactttatcaccagcacgatttctctgtacgatatcctcacgtgttaaattttcctgatgagtctgaacttctacttgctcaataattgcatcttctgagcaaaagtcttcgaccttatcatttttactgccagtaaaattttcggtaaacatcaacgagcggccgatttctcccgcttcgccattaacgcctctgtataactgcctgttcaaaataatgcctgcgccaatccccttatgaatactaatggcaataatattattcttatccttgccgtcattgaaatcgcgctcataaacacctgaaagatttgcctcattttcaagaaggacgggtactcgatactttgtggagtacaattcgaccagatccacaccctccatatcaataaaaggcgaattgatcacctggttatcttgaacaattccatgaatggaaaaaccaattccgagtagtccacgcttggtctgatcgttttgcattgaaactttgatctgatgatcaatcattcccagaattttttgaatatctctactgccaagctcaattctttgatagtaaaagacctcaccactaagataattgcccatcacatgaaggtgacggaaaccaagatcaaaactgatcgtatatccatattgctcattaatcttgactaagaccggtttcctaccaccaacattggttgattgccctgaaccgacttcctgcagcagacccttttcgtctagttcattatacaaagcagataccgttgatttatttaaatttaacgtgtgtgaaatatcaattcgcgaaataataccattgttaaaaatttgttgcagaactagattcaagtttcgcttatgaagctgctccctccccgttgcattagtcattaaattattccctccattttttatcactaaattcaacaatcaacctaactgagccacgagataccgctatattttcacgaaggcagtgattacgatgatgacaccttcagattaaatacgatattttggttgtagcatcaaagttgttctaaaaaaccaactatctaaatcaatttacaattttcatctaacggtgtcaatagcattttgtgaaggcttacatacaatttcaatcaactcagaaccaatccgcaagattgattagtaggcgggagtttacctacttttgaaatttttgaaaatgttccgccaaatattttgtcgtcaagctccgcggatccttaaccaaatccgccggccgacccttggcgacaatccgaccaccctgatcaccaccacggggtcccatgtcaatcagataatcggcattggccattaggtcaagatcatgggtaatcatcaaaacggtggccccctggtcaatcaactgtgaaaagacttttaacaacacatgcacatccagtgggtgcagcccgactgtgggttcgtcgaagataaataacgtatcattttggcggctcttcatatgagaagtcagcttcaatcgctgggcttcaccaccggatagactcggggtggcctcccccaagtgaagataacccaggcccatctgctggagaacttccaaggtcttcaaaatggattcatcgtctttaaacaaatcaatcgcgtgatcaacgtcgtagtcaaggacgtcggcaattgatttgccattccatttgatattcaaaatatcctggttaaaccggcgacctttgcaggttggacaggtttcaaccatgtcaggcagatattgaatatccagcgatatttcaccagttcccccacaagcggggcaagccccctgcttattattgtaggaaaaataacttggggtatagtgatgcttcttggcatcaggcagctgggcaaacttcttgcgcagattgtccataatgttggtgtaggttgccagggttgaccgggcgtttttcccgaccggagtcgcgtccacactgacgatatgcttcattttgccgggttcaaacttgctaatataactcggtaatgaatggttgtgaaacttggcggtgaaggcatcaagtaaaccatccaaaacgagcgtcgtcttaccggcacctgagaatccggtgaccgcaatcaaccggttaaccggaaattctgcggtaacatcgtttaaattaaaccgctggttgattgtcagcatcacagcccctttggcaaaaacatcgtcattggcaatctttcgggtcaccaactgcgctttcccagtcaaaaacggtccaattaatgaatgctgactctggcgaatttgagccggggttccttgatcaatcacttggccgccattgacccccgaccccgggccaatttcaatgatgtaatccgccgcgttaataatcgccgtttcatggtcaacgaccaccaacgaatttccctggtcaaccagttggtgaaaaatcttgatgagaccggcaacattgtcggggtgcaggccgaccgagggctcatccaagacatacagaaccccggtagtctgagttcgcaacgtccggccgagttggattcgttgaagctcaccggtcgaaagagatgcgccagcccgatccatggttaaataatccaaccccaggtcgagcaatggttgcgtttgattgagcaattcagtcgtcaagttttgggccaatttctgcatattgtccggcaaccattgtttgattcggtcaacaaaggccggcagcttcccaagtggcatatggctggcttcggcaatgttcatgccgtcaatcagctgtcccagacgattgggattcatccgggttccgtgacacattgggcaggtgaagaaacggtaaaaacgatttagccgtttcaaggcaatctcactcttcgtcgttttcatgctgtcctcaatggcgttgtaggcattttcgtacaaggcgttgtccatatgaaagacccggccgttcttgctgggaatatcgatggtgtaatgtttctgttgaccatgcaggaccatatctttttctttgtccattaattggttatagggtacatcaattctgacacctgccgcctgggcaacaatcggcatgaagtttctgcctggtgtccgccaagcggcaactgccccctcacggatggttttggtttcatcgccaatcaatctgtccggatcaagctgtttggtgatccccaatccttcacactctgggcaggcaccgtcggaattaaaggcaaagtcttcggcaccaaacgcgtggaacttgacgccacaggttggacaggtaatcacacccatttggtcgcccatgacgtccatggcttccgcaatcttaatggttggcgggacttggtggccgttgggacattttggcgaacccaaccgggaatacatcaaccgcagcacgttgaaaatttcggtcattgtgccaacggtcgagcgggcaccgggaacagttggtcgctgccgcaatgccaaggcagatggaatatgcttaaccgagtcaacattggcccggccaacttggctaatccgtcgccgggtgtaggtggccagagaatccaaatagcggcgggcaccttctgaatacagaatgcccatggctaaggatgacttacctgaaccggacaacccggagactgccacgaatttatgtaacggaatattgacgttaatgttcttcaaattattcacttttccaccaatcacttcaatatgatcgggaagcttacttgctggcataggatgactcctttcaaaaatggtgttgtttcaattttaccgcaccattggctttagtgaatataaaaaggtcaaaccattgctggcttgaccttgaatcatacttaaattgttttgagttttcctctgaaatcatcgagcgtcttgtaaccctttttgtccatgatatctttgagttcttttgaaattcgttcaaaaatcggtgtgccttcgtaaccaaatgcggtaccaatttgcaccaaattagcgccacagaggacgtgttcgaaaacatccatgcctgacttgatcccaccagtcccgatgatcgaaatttccgggttcaagcgttgacgaagggcccgcacgttggccaatgcagttggcttgacgtaatcgccaccgaggccgccaaagccacccttaggtttgatcaccactgattcggtttccggatcaacgactaacccattaccgattgagttgataacgttgatataagtaattgggaaatcattcaaaacttcagcaatcccattaaactggttaaagtcaaagtatggtggcagcttcaagccaagtggcttcttgaagaacttgaaggttgaagttaagacgtcccgaacggcatcgaagtcgtaaccaacttgtgacttacctttaacgtttgggcaggaaagattcaattcagtcaatccagagaatgaactttcttggacttttttgagcatctcaatattttggtcaattgacaagccggcaatcgataagatcacttgtttaccgttcttgccttgattttcttcagcaaatttcaaataataatcgatcccgtgattgggcagacccatcgagttgatactgccaagcggtaatgccttcatgcggggactttcgttaccggcccgttcttctggtgtggcactcttagtgacacagccacctgccattgaatccagggtcttattcagctcgtctgtggttgagcagcgaacgccagctgcgtttaacaataaattatcgaattgatagtcgccaatgtgagcggcgagtgagatattattttgcatttgcttcctcccgttttgtccagtcccaaggggctttgtgccaagttgataagcgtgaatactcttcatctgagaatttattttctttgtggccttgggcaattaaatcagcgtaactcagtaacggaaccaatttggtgtcagcgtcggcaatattcttgtcggcgtccggcaacccgtaagtgaagactgaagcaaccccaatcacgttgacgccttcgttgcgaaccgctttaacagcacccaaaacactgccgccggtggagatcaaatcatcaatcaaaaccactttgtcgtccttggtaattcgaccttcaatttgcttaccggcaccgtgatccttgggcttggcccgaacataaatcagcggcaggttcaatctttcggctacccaagcagcatggggaatcccggcagtcgcaaccccgccgatgacggtggcatcaggataattctctttgatattttctgccaaaccgtcggcaatcatatctcgaagggaaggaatcgaaatggttagtctaaagtcggtgtaaattggtgataagattccgctggcgtatctgaagggtttttcaagattgatactgacaatttggtggtcaatcagtgattgaataatttgattagtttgcataattccattcctccaacattttgtgataagcagcaaccggatcttcagctcgaatgattggccggccgacaactaaagctgagctgccgtattctgcggcctgtttaggcgttgcggttcttgattggtcatccttagggaagttcgccggacgaattcctggggtcacatataggaagtcattgccaacctgttctttcagtgaactgacttccaacggggaagtgataacgccatcggcacccgatcgcttggccaatttggccagggagacaacttgatcaaccatgtctaatttacagttctgctcattttccaaagcatcttcagtaattgaggtcagctcggtcactgccaataacttgggagtcggcaccccagcttcttcactgccaagctcaaggccctctttggcagccgctatcatttccgagccgcccaatgcgtgaaccgtcgtataagtgacgcccatccgaccaatttgcatcatccccatcttaacggtattgggaatatcttgaagcttgaggtcgaggaagattttgaagcccttgttcagcagttctttgacaattgtgggcccttcgccgtaaaacagctccatgccgatcttgacggtcatcccttcgtcggttggaaactggtcaatgatcttgaacaagccttctcgattccaaacatcaagtgatacaataagtggtcctcgcataattaccctcctggttaatgacagaaaaagagcccgagactgtgtattcagtacatccctgtactaaatcccacaaaatcacggactcttagattaattgtcgtccgcttttggcctctctgaaccaaattaaagctcttttatttgtttataactttatcacgatggaccaggttgttcaagtgaaacttagtgatcatatttgctgaacatcagatgcattatgtgtatacttcgtgtatacgaaagaaggaagtgatatccatgtcagttaaaattcgcaaagttggcaactcgaataccttaactgtaccaaatagtatcaagccaatcgcacacgagtttgatgtttttcagggtagagatggggtaattgtttatgtcccaaagcatgataatccattccacaatgaggcgttcatagaatcacacgatttaaaacaaccacaagaatttgggggtaaattagttggcagagaaatccccaaagattagcccatacgtcccaaatcaacaagacatcatctacattgatttcaatccatccgtcggtcatgaaatcagaaagcgacgccctgctctagttttaagcaatcaagggtacagtcgaatgactcacttggtggtggttgctcccataacccatgcaatgaataactccttacgagaaagtggctttttaatcagagttaataatgacaaaattgatggttttgtgaatccacttcaattttttacttatgactttcaaagtcatcatgcagaatttgtgagcgtacttgatacaccatcttttgtccgagctaagcaaacaatcacagatatccttaattgaccaacttgcatttccaaaacatccatgtaataatgtgaacagcaaaaataaagaatgtcagcgagcattcatttggaggaacgaacatggaaaatacaaacgcagcacttacgcacagccatacttttacgaagaatcagaaatgggttattgcttctaccagttctggattcgcgctggaaaatatggatgtgctatttttatcttttgcaatgagttcaatgattggccaacttcatcttagcggtggcgctgctggattgattggctcaattaccaacttgggaatgttatttggcgggatcatgtttggtctgatcggtgaccgctttggccgggttaagactttcacctacacaatcttcatcttcgcatttgcgaccgcaatgatggccttcgccaataacatcacattgatttacatattaaggttcttggcaggaatcggtgccggtggtgaatatggcgtcgggatctcaatgattgccgaatccttccacaagaatcaaatcggcaagatgacatcggttgccgcaattggcggccaaatcggtgccatcctggcagcgatcaccgccgcaatcgtcatcccacatctgggatggcacgcattgttcctggttggaatcgttccggtcgtcttaacttattttgtccgtcgtcacttgaccgagactgaagagtttgtcgcagccaagaaggttgaagccaagaagaaagaatccacgaccagcgccgtcttcaagtacatgttcagttcacccaaattagcctatcaaagttttgccttaatgattatgaccaccgttcaaatcgccggttacttcggcttgatgaactggctgccaatcatcgtgcaaaaacaacttggcttaaacgtttccggttcatcactgtggatgatttccactatcatcggcatgagcttgggaatgattaccttcggctcaatccttgattactttggcccacgtcgagcatttggcatcttcttgattgcttcggctgccatggtcttcacaattaccctggcccacaataccatttcgctcctcattatcggtgccatcgtcggcttcttctcaaacggcatgtttggtgggtacggtgcagttatcagccgcctctacccaactgaaattcgttcgacagccaacaatgtgatcgtcaacatcggccgtgccgtggggggcttctcatcagttgtcattggcattttaatggacaactactcattgacggttgtcatgggctttctctcaatcctctacgtcatcagtttcatcacaatgattacattaccaggattgaaaaagatgagtttaaaacgggcataattcaatgaaaattttcaaaaatcgtcgacatcaagccggcgatttttttattcatttgaataattgtgcctagtagcagataatagttgtataggctcatttaggaaccctgtcatgaagtgcacatccggcagggaatcctggtcatgcacttcgaaaggtaggtcaaaaatagtaatggaaaaaattattgcgtttgatatggatggaacggttgccgagactttcccggtaatctttgattcgtttagaagaaccgttcacgattatactggcaaatggatcagcaaccaggtcatcctcgccacctttggagcaaacgaagttgggatgttaaaggagttgatccctgattattccgatgaggtcttggaaagctttcacgaaaactaccggcgggcgcatttgcaattacggcatccgtttgagggaattgaaaagctcattaaggaactccacgaccgcgatgtgatcacgccaatgattaccggcaagggtgagcaaagcctccaagtcagtctggactcacttggattggcggatgcattctcccctgtcttatcaggatctcctgacggctcgatcaaagcagaacaatttagtgacgtgatcaaacaatttaacgccaccaaagacgatatggcatacataggtgatgctccaaccgacgtcgtcgcctgcaagcaagctgggattaaatgctactcagctgcttggtcaattaatgccaaacacaaagagctggagaaaattaatcccggtgaggtttatacttcagtggatcaattacgagataaatcaatcaatgattaaatcgacttacaaaggggccgggacaaaagtgaatgctttgccccggcttttatgttacccagccaaatagtggaaaaataaacagtttccggccatatcagggcgtgattcaaacatccaaaatctggatatttgaatcacgccctgatattctggcaactaagcgtttatttttccacactgtcttaattatgataaatcctctaataatcgactgccaactggcgtataatggatgccaatcaaagatttttactggaaaggactggataatcgaatgaaaattgaagaaggttacatgccatttaaaggctacaaaacatattaccggatcgttggcgagaaaacacctggaaaagccccactgctgctgattcacggtggcccgggttcatcacataactatttcgaattactcgatgattatgccgagactggccgccaactgatcatgtatgaccaaattggctgcggcaaatcgtcgattccagacgacgaatccctctacgttaaagagacttgggcagaagaattaattgccctgagaaaatatcttcatttggatgaagtacatatgctgggccaatcatggggtggcatgctggaaatgctttatttgactcattatagccaagaaggtgttaaaagcgtcatgatcgatggctccccatcttctatcaagttatggattcaagaacagcaccggctcttgaaatatctcagctacgaagatcgccaggcaatcgctgaggcagagcggactggaaacttctctggccccaaatatgccgcagccaatgaccgttacatggaaatgtactgctgggatgatccagacgaaaattcgcctgaaccactccgccggccaaccaacggtaaaaaagccagtttgatcgccgaaggccccaatgagtttaccgagaacggcaccatcagcgattttgacgtcactgatgacttaaagaatattcatgtcccagtattggttaccaacggcacagacgacctctgcaccccgttaatcgccaagacggtttatgatcatattcctggtgccaagtggcatctatttgccaacagccgccaccttgctttgctggatcagcatgatgaattcatcaacgttcttgacagctggcttaatgagaatgattagcgatgaaagtcattatttcaccagccaagaaaatggtcgtcaatcaagatgattttgatgtgcagggaatgccggtgtatttgaaacagacgactgaaattttagatgcattgcgtcagctgagttacgaccagctcaaaaagttgtggcatgcgagtgacaagctgacccaagctagttaccagcaattacagactattgacctgcatcatcgattaaccccagccattctaagtttctccggcattcaataccagtacatggcgccagacctcttgagtgcagcggcgctgacttatctgcaagaacatttacgcattctctcgggattttatggcattctgaaaccctttgacggcgtggctccctatcgttttgatatggattcaaagttaacgatcagtcctgccaaaaatatgtaccaatactggggagatcgcatttaccagtctttggcagacgatcaaccaattatcaatttagcctcccaagaatacgccaagaccgtcacccaattcttaaaaccaaccgatcgtttcatcaatatcacctttggtcacttggttgacggcaacattaaaaccagggcaacctttgcgaaaatggcgcgtggtgaaatggtccggttcatggccgaacatcaggttgaacaaatttctgacctgaaagatttcgattcacccaactatcggtttagtgaaactgactcaacagcggacaatttggtttttctgcgcaaataatcattgatccagattgaggcaccgactcccagtggcttcggtgtcttttttgccatcattattgcttgaaatcactttgataagtccgctcactgactgtgacaaagctagtaagattggccagccacactcaaattataaaaatcaaaaacgggtatccaaactctggatacccgttttgtgttgttcaaatagttttataaatctcgaaagccaatatcttttcggtaatagaatcctgacaaatcaagccggcttaactcagcgtatacttttgcctgggcacattccagagtcgaagcatgattgtataacgtaaagattcgcccgcctgaactgtaaagtttcccatcttcctctgttaccccggcataaaaaatattccgtggtaaatcatcgggcagcgcaatatgttgcttgggcgaagttgggtatcctggagcagaaaccacgacgccaagatagaactcaccctcctgccactcaacttttggcatttgatggtcgatcaaatcagaggtcatttggtaaaaatcactcttcaactggggtaatagaacttgggtctccggatcacccagccgcaagttgtattcgatcacttttggcccctgtttggtcagcatgcagccgatgtaaataatcccggcgaactctaaatcctctttcgccagtccagccatcgttgggttaacaatcttttgaactgtggcatccaaaacatcttgggtgatgtgtggaaccggtgaataagcacccattccaccagtattcggacccgtttcaccttcataaatctttttgtgatcttgtgaaattggaaagattaccttcttgtcaccgccaacaaacagcatcagtgaaaattcttcaccttccagaaattcttcaattaaaatttcaccggctttatcaagtgcgtgttggatggttgctgccaggtcggctgagtctttcacaattgtgactcctttaccggcggccagaccattttccttcactaccagtggcaatgacaaactctcagcgtacttttcggcatcatcaaaggtcgtaaatgttttgaactgggcagttggaatgttgtttcgggccatgaatcctttcgcaaacgtcttgtcactttcgaggcgggcggcagactcatctgggccgaatacccgcaaacgagcggcgataaaggcatcaacaatccctttggacaacggcacttccggcccaacgaacgtcaaatcaaccagatgctctttggcaaactccaccaagttgggaaagtccatttcatcgatatccacaatttgaatgttatccttcttcattccaggattaccgggagcacaatagacattggtaacctggggactttttaacattgttgctgcaattgcgtgttcacgtgcaccggatccgataaccagaacatttgtcatgatttgatctcctttttgattgttgatggttggtttatgtatgaaggctgatggacagccttgttgtgcttatttgatttgtggttttacttgttggaaacgattaggcagccaagccgaaacgtgctcctcggggcaacaacctgcacctaagccggctttgggcgaaatcaaaaccaatttcccccaaagccaacttaggctccggttgttaaccgccccgatccgcactctgctcgaaatgcgctccaatgcccctgccccctaacgtgtaagccaaaaattcaaacgatgaacgaaacccgttcatcatttaaatttccgccttacacaccggggacacccggggctcgtcgcgctctgcttctaaaatacgctccgacgggcctgaccctaacttccaagggtactttgattacagtcccaaacccagggacttcaatcaaagtacccttggaaaccgggtcaaccagcccttgtcgcgctctgcttctaatgtctaaaatgtcttaccccggtcatcaccatggcaattccaaacttatcagccattgcaattgaatccttatccttgatactgccaccgggttggataatggccttgatatcatgcttggctgcgtattccacacagtcatccattgggaagaaggcgtccgatgccataatggcattttcgtaaccgtccttcggcattgccttttggatagcaatcttagctgagtcaatccggttaggctgacccatgccgacacccaaagtcttggtatcggttgttacaaccaccgcgttactcttaacgtgcttaaccacgtgttggccaaattgcaaagccttcaattgctgttcagttggttggactttggtaaccactttgaagtcaggaatctgatcaatttcatggtcgctttcttgaattaacatccccccactcaccgtgatttcttcgaagcgatcaggttcgtttcggtgactcaaatcagctttcagcagacgaatattcttctttttagctaaaatttcaaatgcttcatcagtgtatgatggcgcaatcacaatttccaagaaaattttgtgcatcttttcggccgtcgcagcatcaatttctcggttgacagcaataattccaccaaagatcgacatcggatctgattcataagcttcatcccaagccttttcgatggtatcagccacaccaaccccacatggattcatgtgcttcatcgcaataaccgttggttgatcaaattcagccaccatattcaatgcagcgttagcatctttgatgttgttgtatgataactctttaccatgaagctggttgggaataatcgacagttttgacggtaacgccttgcggtagaaggctgccttttggtgactgttttctccataacgcaatgactgttgcttttcgtaagttaaagtcagtttttctggaaattcttcttccgtcaaataattcgaaatgagggcgtcatatgcggcagtgtgtctgaacactttagctgccaaatgttttctgaaatcggcgtcatcagtgtgtgccttcagagcatcaatcactggttgatagtcagctgggtcaacgactgtcagcacgccggcaaagttctttgcggctgcccgcagcattgatggtccaccgatatcgatttgttcgattgcttctacttgagtggtctcaggtttttcaatcgtctgtttgaatggatacagattaacggcaaccaagtcaatgggtgtaatgccggcatcttttaattgtttcatatggtcgggatcgtcacgcttggcaagaattccggcatgaatctttggatgaagggttttaacccgtccatcgagcatttctggaaaaccggtgacttcttcaacgccggtcacttcaacgccagcgtcttccaaggcttttttggtgccgccggtcgaaacgatttcaaaatccaaatcctttaactgtttagcaaaatcaaccaaattacttttatcagaaacacttaaaagggctcttttcgacattaaatttctcctctttctaataattgtttgacaacgcttggatataacacgtgttccgtcgcatgaatccgctgttcaaggtcactcaactggtcatccttgtggactggcacctcgcgttgagcaatgatttttccggaatcaatcccggaatccacccagtgaaccgtgacaccggtcgtatcgacaccagcttgataggcatcttcaatcccatggcggccagggaacttcggcagcagggccggatgaatattaataattttgccttcatacttggctaacaaggtggggccgatgatccgcatataaccggccaaaatgatgaagtcgatttgggcttcctcaagcttctgggcaatcaccgtttcagcggcagctttattgggataatctttgaagttaatcacaaatgttggaacggattccttatgtgcccggtcgaggacgtgaacgttggaatgatcacaaaccaacaacctcacattgagcggtaagtgttcttttttgaaagattccgtcaatgctgtgaaattggttccctcaccggatgcaaatatcgctatgttttttacgtcagatttcattgctgatcctttcgaatgattacttgtttgtcgccagaaatgagcttaccaacccgtgaaacggtttcgccagctgcttttaattgtgattcaacggcatcggcatcagctggatgaacggcaattaccatgccaagtcccaagttgaaggtgtgcaagagatcatcaaatgataaatgaccaatttcttgcaagtctgtcatgatcgccggcacctgccaactgccatactcaaattctgccgaaaggttatccggtaaaatcctggcaacattttctggtaacccgccacctgtgatatgagcgattgatgcgattttgccctgctcgatcaccggtaacactgattttacatagatcttggttgggcgcaacagttcacgcttcaaatcatgctcacagccggacagctgatcatttaatgaataggcattctgtttgaacaagatgtctctaaccaaactgaaaccgttggaatgaagaccattggaggcaagtcccaacaagacatccccttcacgcaaattgtcagggcttaagagcttatcggaatcagcaataccaacagcaaatccagctaaatcataatgcccatgagtatacatatcgggcatttcggcagtttcgccaccaaccaattttgcctgagcctgagaaaccccttcgaccacgccggctaaaattgctttggctttttcgttatccaggtgaccaactccgagataatccaagaagaacaacggctttgcgccttgggccaacacatcgttgacacacatcgcaaccaggtcgatcccaatggtttggtgttgattggctttgatagcgatcaacaatttggttcccaccccatccgttccagaaaccagaaccgggttttgatagacacccagcgacaagggaaacaacccaccgaatgagccaaggtctttattgtttgataaattcttaatatcatcgactaacttgtaaccggcgttaatatcgacaccggcctttttataggcgtccattcgaattacctcatctcattgattgtagttgggcttgatcacggtcgtattcttcctcgtaatcgtaaagcggggttggatatttgccgtcaaaatatgcaacacagagacccttattaggtgcgtcggtcttcaaattaactgaatcaatcaccccttgaacactcaggaatcccaaagaatcagccccgaagatttcgcgcatttgttcaatcgtcttgttagcggcaatcagttcgcgaacgtgctggatatcgatgccgtaaaaacatggataacgcagcggcggtgatgcaatccgcaggtgaacggaggccgccccagcatccttgagtaatttgacaattcggcgactggtggttccgcgaacgatcgaatcatcaaccaacaccagattcttaccccgaacgacccctttaacagcagagagtttcatattcataccctgttcacggagtgcttgagtgggttcaatgaatgttctggcagaatattgattcttcaccagacccatttcataaggcaagcctgattcttcagcgtatcccattgccgccgacaaggacgagttgggaactccaatcaccatatcggcattttcaaccggctgttcctgagccaagcgagcccccatccgttttctggcagaatggacattaacaccgtaaatgtcagagtcggggcgagcgaaataaataaattccatcgagcaaatcgccaactgagtatcgtcggtatatttatcaacggtgatgccggaagcatcaattttaattaactgacctggttgaacgtcaaatttgaactcagcgccaacagcatccaaggcgcaagtttcgctgcagacgacgtaagcaccatttggcagctgaccgacaacgagcggccgaaagccattgggatcaagggcagcatacaagcgatccttagtcatgaccaagtaggcaaacccacccttaatgatgttgagggcttctttcatctggtcgtccaagttgtcttcttggctcaaccggatcaaatgcatcaggttttcagtatcggaactggaatgatagatcgcaccacggtcttccaagttctttcgaattgaaatggcgttggttaaattaccattatgagcaagcgcaaattgggtatcgctaaagttaaagggcagcggttgaatattttccaataagttactgccggcagtcgagtagcgaacgtgaccgatagcagcttgaccggtcatttcatcaaccgcgttgggtgaatcaaagacgtcggtcaacaagccaaacccccgcttggtggtcaaatggccttcattattaaccgtaatcccggcaccttcttggccacgatgctggagggcaaataagccaatgtaggtcaatttggcagcgtcaggcgttccccaaacaccaaagatcccacattcttcatttaaactttttacttcagacggcatggcaatgcccctttccaaataccaaatgctttatcaacatcaagatcaaagtaaccatcattggcttggacaaataggtgattgtcatcgactacctttccaagcttttctgcgtcattgccaactaattgctcaaattcggcctgcttttcttgtggaactgaaacgacaaatcttgattggctttcggagaagaagtcagcaacggttaagttacctgacaggtcaacgccaagctgattgccaaaagtactttcagcaatagcagtaatcagaccgccctcagagatgtcatgagctgaattcaacaaatgttgttgaatggcagctgtaattaatttttgaattttcacttcataatctaaatcaaaattgaagagcttgccggcaatttttccggtttgcattttttgaatttgagaaccgttaaatcccggttcagttcgaccaactacataaaccaggtcgccggcttgcttaaagtcttgagtcgtgatgtggtccaggcccttgatcaggccaaccatccccaccattggcgtagaatagactggaatattatcgtattcattgttaagggaaacgttaccggaaatgacaggagcttcaaacttttcacaagcctcactcattcccatcactgcttgatccaattcatagaactgatcgggcttttcaggattaccaaagttcaggcaatcggtaattcccaacggtacggcaccagatgcaacaatgttgcgggcagcttcagcaaccgccatggcacccccgactcgaggattcaagtagaggtagcgaccattaacatcagttgtgattgccaaggccttgtcgtggtgtcgcacccggacaacggcggcatcggatccaggagccacaaccgtgttggtttgaacctgggtatcataggtttcatagatactttccttagaagcaatggttaattggccaagcatttctttcaaggtttcagttgggttgctaatttgaggttgatactgattctcatcggcatttttcaagtgtgctggtacagctgattcacggtgataaaccggtgcttgagaagccagggagtcaaccggcacatcagcaacgactttgccgtggtgaagaagtttgtaattatggccttcagtcacgtggccaataacgacggcgttaacgccatggtccttaaagacattcaaaacttcatcttcatgaccggctttgacacacaacagcatccgttcctgcgactctgaaagcattaattcaaaggcggacatcccggcttcacgttgtgggaccaaatccaaattcaattccattccgttgccgccagccttggagcccatttctgccgaagatgaaaccagtccagcagcacccatatcttgaattccgactaaggcgtccgaatgattgttgatgacgtcaaggcaaccttccatcaccagcttttcttcaaatggatcaccaacttgaacggctgaacgttgactttcatgttcagaatcaaattggaaagaagcaaacgaggccccgttaatcccatcacgaccggttttatggccaacgtagataatactgttaccaacgccggcagctgcaccaacttcaatcttatcgagatccatcaagccgacagacatcacgttaatcagtgggttgtgggcgtaggcatcgtcaaatgccgtatctccgccaaccgttgggatcccaatacagttcccataagcactaatgccggcaacaatttgttgaataaaatacttgtccgcatcggttttcggttcggcaaatcgcaagctgtccatgctggcaattggtcgggcacccattgagaagatgtctcgtaaaataccaccaacgccggtcgtggcgccttggaaaggttcaactgctgaagggtggttatggctttcagctttgaaaacaactccttgattatcgccaatatcaataataccggcaccttcacctggtcctttgacaacgtgtttgcctttggtaaagaactttttaagaaccggcttggagtttttgtaagaacaatgttcactccacattcctgagaacaaaccgacttcggtgtagttaggcagccgatgcaagacatcatctttaatcaaaccatattcgtggtctgtcaatcccatcgattggtacaacttgttatcacgaatttgttctggtgtcgcttcagttgtttgatccattacactattcatagattacccctcgacttttaatgtgattaacgatcgactggaagacgcccttcccgtcatcagacccaagcattgcttcaacggcccgttccgggtggggcatcatgccaagaacgttgccggctttattggtgatgccggcgatattatcaacgctcccatttggattattggcatacttgaaaacgatttgatcattggcaaccagttcccgcaaagtatcttggtcacagtaataattgccgtcaccatgcgcaatcggtaagctgatcaactgcccagcttgataagctgagctaaacatcgagtggtcattattaacgaccagaggttcagtcttgcagataaacttggcagaaacgttcttctgcaagcttcctggcagtaatccggcttcggttaaaatttgaaatccgttgcaaattcccagaactggtcgaccacttttggcaaaatcctgtaatgcaggaataatcggtgaaaagcgggcaatggcaccacttcgtaagtagtcaccatatgagaaaccaccaggaatcagaacagcgtcaaagccggcaagtgaatcgttcttgtaagaaaccagttcaacatcttctttgatgatatctttaattgcattgtagaggtccatttcacagttggatcctggaaaagcaaggacagcaaatttcattgggcagcctccgtttcaacaatctcatagtggtaattttccatgttgtaattagcgagcaatttgtcacaaatttcgttaatttctttatcaatctctgctttggatttgccgtcagcaatggttaattcaaagtatttacccagcttaacgtcctgaacatcgctgtatcccaaccgtttcaatgctttatgcacggcttctgcttcgggatttaagattgatttcttgtagttaacataaacttttgcaagagccattatttaacatcctccactttttcaaggcggccaagaatttctttatatactggtactaaggcaccgaggccttttctgaagacatctttatcaagtgacttttgcgtatcgcggtcaattaatcggcagctgtcaggagaaatttcatcggccaaaatcaattggttgtcggaatcaatgccaaattcaactttgaagtccaccagatcaatgttcatttctgagaaaatttctttaaggcggtcattaactttcagtgcaatcgccctcatctgattcatttgatcttcggttgccaccttcaaagcctcagcttggaaatcgttaatgaatggatcatccaattcatcgctcttatagaaaaattcttgaaccggcttgtcgaatttcattaaatgcttaacggcaaatttcttttcaaaactgccggaagcaaagtttctgacaactgtttccaatggaataatctttacccgtttaaccaactgattgttggaatcaatttgcttgataaagtggttcttaataccatgattggcgaggtccttgaagatcaaggctgaaatttcacagtttgtttgacccttgcctgccatttgaacttttttcttgccgttaaaagccgttacttgatccatgtagtgaacccacatgatgtcaggatcgttggtcgtgtacatttccttagccttacctttatacaacaaatcttttttcacaatttcagtcattttagtcttctccctttaacatgtcggttgatttcagtaactggtcgatgttgtcaccaacgacggtaacgtggcccattttgcgttgtggtcgaatctctgccttgccgtaatcgtggaagtgccattccggatgttccttgagtagattgcgggcaagggttaaatcggttcctaacaggtttctcatcactgcgggtttttcctgaacaatttcaggaatcggcaagccgcagatgcttcgaatatgtgcttcaaattgagagatgttgcaggcttcgatcgtgtagtgaccggagttatgtggacgcggtgccagttcattaaccatgacgtcttggtcatcaattacaaacagttcaatgcctagaaccccatataaatcaagctgattagcgatagtttcggcatactgttttgctttagcatggaccgtcttggaaaatctgcctggggcaatcgtcgtatgaagaatgtgattcttatgacgattttcaaccagtgggaaggtaatcactttgccattcaagtctcgcgtaaccataacggaggcttcagcaatgaagtcttggcgggcttccaaaatacattccgctttggagtacagtgacgaggcttcagcaagatcgtcggcagaattaatatccatctgaccgtgaccatcatagccaccggaaacggttttgagaattgccggatagccaacttcgtcaacagcaactttaagtgacgcttcatcggacaccgcagcaaacttggttaccggaatgccacaatccttgatgaaatttttctcgttcaagcgctgcccagtgatatgaagtaagttgacgccttgaggcagctcagccaccttctttgccttgagcagtgaatcttcgtcgacattctcaaactcgtaggttaacacatcgctttgttcagccaacttcatcaatgagtcaacgtcgtcatattcggcaacaatttggaaatcagcaacttgcccagccggagcgtgaggtgttggatctaagatgcccacgtgataccccatcgacttggcaatcagtgccatcatctgtccgagttggccgccaccgacaatgccaatcgtagctggcggtaagatagttttaatcaaactgctgctcactgtttttggcctccactctctgggtttcttttaaatcagccaacttcttcgcgatagctgagtcagttgttcctaaaatttgagctgccaataaggcggcgttcttggcaccagcctcaccaatactgacggtggcgaccggagccccaaatggcatctggacaattgaaagcaatgagtcaacaccatttaatgttcgtgttttcatcggaactccaatgacaggaagtgtcgtgttggctgcaatcattcccggcaaatgagctgcgccaccagcacccgcaatgataactttcatgcccttgtccctagctgtcttgccaaattcttgaagttcatcgggcattcgatgagctgagataacgtgcttctcataagggattccaagactttcaagttgttcacaagccagtttcatcgttggccaatcagaaattgatcccattgccacaccgacaacgtttgccattccaaccactcaccttttcaaatttatttagtgtctataggatacttgccatcatcatggaagtcaacgtcattgttcgtgtttaaaacgatatattgcaacttttaccaaaaatatttgattaatttacgtgtttggagccgtccaagtttcaaaagatggtcaatttttaacgaccgtggacctgtccaccaccaaatacgcttagttaaagtatcaaccgagatgttatgattgaagcaagtagattgctatttggaggtaacactaatgaaattcagaacacttggtaaaactggttatagtgtcagcgaggtttcccttggtacctggcagttaggtggaaaatggggcaccccgtttgaccctaaagatgctcgggacacactcgaggaagcttatgatcgtggtgtcaacttctttgatacagctgatggctaccaagatggccaaagtgaaaaagccgtgggtgaatttgtcaggaatcatcctgatgttcactacacgactaaaattggccgaaaagaaatgcccttggatattaagcactttgacccgactcacttggaccggtacgttgatgagtcattgcaaaacatgggtgtcgactcattggacatggtgctgctgcactgcccgccaatgatgaattactacatgcctgaaacctttttgaactggacaagctcaagcaagctggaaaaattcagaactacggtgtcagtgtcgagcgggtcgaagaaggcatcaaagccctcagttatgacatctcggctgtcgagatcatcttcaacatgtttcgccttcgtcctgccgatctcttctttggcttagcgaagaaaaataacgtcggcattttggcccgggttccactggcaagtggtcttttgaccggaaaatttaccgcggacaccaagtttgcacccgaagatcatcgaacaactaatcggcatggtgaacagttcgataaaggtgagaccttttccggcgttgactacctgaccggcgttaaagctgctgccgaactgaagcaacgtttgggaaccgataatcttgcagcaatggctttgcgtttcatcctaatgtatgacgccgtttctgcggtcatccctggtgcaagtaatcccactcaaatcgagcgcaacaccactgcagcggatctacccgcgctgactgatgctcagatgcaaattgtccgtgacgtttacgatcaacacatcaaaaatccagttgaatatctctggtaatttgttcttgatggcaatctgccatcactcgtccagtgaagtagtgtgcccttaaggagtggtgaaaatgagaactcggcggattatactgactagtgcaatcagtatctgcgtcctgttaatatttgtctcaatcaatgttgcactcattggcctcattctggtattgtcatggacaagctatcagcttctgatcaaaaaagactatacgttgctgcagactagcatgtttcaaaatgcctcacttaggatgccggattttgataaattaagtcaggaacaaatttcaacctatcagcggacagcttatcgggttggctggtggatcctggcaagtacgattgcctgtgttatcgtgctgatttgtttgaatctttgaattcgaaaaaatgatattaaaaaagttccggggcaaattttgcttcggaacttttttcgtatctaggttaatgattaatcttcgtcgtcttcctcgtccaagccctctcgcggtgtcttcccaagtaaggcctgcaaggtagcgatgttgtggttgttatcccgcagtacgccaaccaaatgttgtgccaagactggacggtcttctttttcagccaacttaattgcccgggtgacaaacatgttctcagtgtcatagtcatggacgaagtcgttgaccagccactctgcagattcatatttattctggccattttcttccagcatggtgtactccgtgaattccttttgggtacttggcgtgattaacgcttcatcgattaagaccgtgcccaaggcatccttttggtcatacgcctgcttaagtaagtcgccgaataggactttcagctgttgggccgacattcccttcacataccattttgccatctggagtttgttggataaaacttccaaattggcaacaatgtggccagtcatcgcaccagccgttggggtatggtggtcgatatctgcttgcttaacttctgcttcaaataatttttctggggttgctgttgtcatattcttcacctatttcactttcattgattgaacttcatagcctaaatcagttaccgtgtctgacaatttgtctgcggaaattttatcgccgtcaaaatcagttttgactttggctgcattgaacaacactttgacgttttccacaccatcctgcttttcaagtgcgcccttgattttctgcatgcatgacgggcatgacagcgcgtctaattgtaaaattgctttactcatattgataacctccatctcatttactgttttaatgataaatcatattcgccaactgataattgatctggatcaagtttggcggcttttggttgataattaattaatcgcattgcgttgaagatgacaaccaggatactggcttcatggacaaacattccgctggccatgtaaataaatccgagaatcaagccaatcaggagggcgacaaccgtcgcaatggcgatgaaaatgttctccttggtgttgatgaccgtttttttggaaagtccatatgcatggatcaattcatcgaatcctgatgacatcaagacgacatcagaggtttcaactgccacgtcggttccacttcccatggcaattccgatgtcagcggttaccaatgacggactgtcgttgatgccgtcgccgacaaaggcaaccttgtggccttcctgctggaattgtttaacgtattcgactttttgttccggcaaaagttctgcgtgcacttcgtcgatgccgatttgttctgcaacggcattggcggtctgcaggttatcaccggtcagcataaccgtcttcttgatgccgagtgacttgagggttgccaggctttgcttaacgccttgacgaatcacatccgagataccaagaatggcttgaatttgcccgtcgaaggcaacgataactgttgaactgccttcgccttggatgttttccaagtcttgacgttgctcagacgtcaaatcaacattttcatcgttcatcattctcaagttaccaattaaaacattcttaccgttggcagttgccttaacgccacggcctttgactgtgtcagcatcggcaacttgaacgtcatcaaacggaatatgatgatcagctgagaatttaacaaccgcttgtgccaacggatgatccgactgcttttcaacggctgcagcaatttgcaaggccaactggtcttttgagtagtctttgaactgagtaaccgccgttttcccttcagtcagggtcccggtcttatcgaataccaacgtgtcgacattggcaaaggtgttcatcacttcaccgcccttgatcaaaacaccgtttttcgcaccattaccaattccagccacgtttgaaaccggggcgccgataaccaaggccccagggcatcccaagaccaaaacggtaatcgctaatcggaaatctttggtaaccaagcccacaatcagtgcaatgatcaaaactgccggagtgtaataagtcgcaaatttgtcaataaacttttccgctggaatagtttggatatcttttattgtatttttccaatgccttctttcatacctgacttccctttgctggtttctatccagcttttgtccctttctccaagtcgtcttataaggcttgtgttttgtcttattgcttggctgaaattgaccgtttgaatgcatagatttctgagaataatgatcagaatgggagttgcgagtttccttattctgtggctgtttttgagaagtaacagatgtagaagcaccattgttcttagagttgttactttgaaactgagtctggttagaacttctaccggtgacagcactacctgttttcgtagttgcagaaccaacagaatcgttgacacctgtcatgccctcagcagtgctgttattcgtcccattaacggactggccttgaggattggatacaacagtggcagaaccattattggctgtggcaccagctgttgcaccaccggcagatattcctccaccgccattgttattgacgctactcccaccggaatttccaccaggaatgtagcccccaccgccattattgttattattatcgttattaccgttgtcattgtcgttgtcgttgttgtcatcgtcattattttgattctgactgttagtgacattggtgaattggctctgctcatgagcggacgcaccagttgtcccaaccaacaacagcgacattatcgaaataccaactaaacttaaagctctatacaaatacttgtacttgataggcttcatcatcattatccccctctagatcaagttaaagcaagtttctaatggttgagataatctcacagattgaattaacaattgcggttccctgaccaacaacattagaaaaagcacccgtaatatcgtaaattgcttggcccttattggcggaaatttgcgattgagttaactgaggctgcagctggatattttgattttgtgcatcctgatttgcttgggcttctgccggcgtgatcgttggctgagcctgagtggtattttgttgcgcggcagtattattggtattcactggtgtagctgcattggtcgatgtatcggcttgggtcgaattggtactgtcagcctgattgctgccattcgaattatcagtggtctgatcagctgattttcccttcttggtgttattaacaacctgcttgcgaatcacttgttgcttaaccgtcttagttccccgtttagtcttcttaactttggtgttggttttcgtttctctgtactcggttgaacgagaaacggtctttttggctttcggcgttgctgattgattaactgtatccgcttttgaattgttggggtcattgttcgacgccatattccctgcagtgtttgagctttcaacaccatttgttgattgaaccgaagcactcttacttgtatttgtatctgatgtcgcatttccggcaggcgacacaactgaggtttgagcaatcggttgactatttgtgccggcagtggccgcatgtgcaccaaccgctccccctagcaaacccccataacggaaagcgctagcaatattgtttgttcaatcttattgactttcattcttgagacccccaaaataatttgttttacctgggtaacatttattgtacccatttctcgttatagcactttacgaatatattacaatagctttgttcaatgggtaacgggatgttgaattttgttagattttttcttctatatttgcgacaggacagccaaactaattaaatattttaaatatttttattcacaattttgtccaaaaaaataattgacaagttaaataattagaaccaatcccactttaggtactaaaaagttaccaacagggggaactatcatgaacaagattatcaagtggatcatatcatttgtgggaatcttagtactatcagttatgttcagttcaacggccagtgccagccgggtacatgattgtttccccgccccaattcaaggaagatattggcgtgccacggtcaatcgaggggctaattctattccaaaacatatgtacttttatgctgttaaagacgggtttgtcattaaaaatacagctacgggaacgctcagatgcaaatggatgatttacacgcatgattacacgacatatgtactaaatggggcggaaaacaatgacctgtcaaaagctgtttgggtcttcattacacctgaaaagaattggaagactgtcaagattggttataaaatcacaggtataaatggggaaccaaagtatcccgctgctcattaccagcattacataggtaccgcaatttccaaagtaacagccatcgtgcactaaataaacaatgacgatcaacaaaatagaagccccagagcaatccagctccgggacttctatttgttattgattttatattattaatataggtagtaatagcttaaacaatttcaagatgcagttgttgatccttaacccagtgcatgccgagaagaactctgtaaagcacgattgagataacggctggaacaacgattcccattgccaggtaagcaacgaacatgttcatgttggttgatgccaggttaagtggggcgataaatgagttcaatcccaggccgcctaatgtgtaaggcaccttgaagccaaagaacattgtcgcaatcggtgcggccaccacagcggcagtcattgaaggaattgcgagccgtgggttggccaacaagttcgggaactgaacctttggtgtgatgaagccttgggcaatgttggcaccaaggttgttttgacgccatgagataaccgtgaagccaacaaattgagcggtcgttccaatcaatgcggcacctgatgaaagtggatcaagcataacggcaactgccagggcagctgacgatgccggtgtcatcaagaagagtgaccatgccaaggcaacggccattgagccgaggattgggttaacctgcattgattgagcgataaaggcactcaaccagttaagggctggcgtggtgacacttgcaagtcccaagccggcgattgaaccaactaaggttgaggcaagtggtactaacatcatatcaagtggcgttttaccggttaaatacttaccaactaaggcagcgattaacccggcggcaacggcactaataggttgaccagttgtgaagacaccggttccggctgcttgtgccatctggttaccagtggcggttgctgcgtgaacgccggatgaaatgaaataaacggcgttggccccaacagttgaggcaatcatggaactaaacaggaccagtgtgttggtttttaattgagatgcaacagcggcaccaaatgcaggtgccaataaccattgggcaattgccccgacttggtgtaactgtggccaattcacgaagttggcaatggtctgggttaataatccgacccctaacatcactaggacggcgtttgaaacccctgctgaaactaagtatacgtaatctttgactgtcagtttatcaactggcttatttgcttctgtatccattggcattacctcgcttttttctataattataattgcgtgagaaaataatgataaaaatgaaattgttatcatttaaacatcattacgtggagatgtcaacacccattttagaaaagaaatcgctgggggccatttgtgtacatagaccgtttttgaagtaagcggtcgcaatccttaagggcattgcttaatgagcgatagacaatatgatcagcaaaatgatgaacgatcggcaatcgaaactttggtgactgggtaatcttctcatattgattcgctattttgatgagaattctttcataattcatcaaattttacgatccctggcttaccgtaccctcagatgcggcatggcatgctggagtatatgctataatcaatttaacatcactaagatcgggagatgaaacaatgagtaaaatcgcaatcgtaaccgacagcacggccagcctttctgatgaagaagtccaacggcttggcaacgtgactatcgttccgatcgtcgttaacatgaacggtaccacctatcgtgagggaattgatattaccaataatgaattctattccgcactggcgaaggccaaaaaattaccgacaactgcaccgccgacaccgatggaaatgttaaaagtgtatgatcagctggccaatcaaggctacgaccagattctaagtattcatttgactactggtatcacgggctttgtcaacaatctgcgcactgtagtccggggctataccaacgcccaggttgaagtctatgattcacacatcacgattgaaccgttgggatatcttgtgaaatacgcttcaatgatggccaatcaaggcgaatcaatgagcacaattctccaaaatctggatgatgtccgggcaactatcgatgaatattttgtcgtcgatgacctcaagaacttagttaccggcgggcggctcaccaacgccgctgcatttgcaggtggcttactgagagttaaaccgttattaactttgaacgaccagcatcaaatcgaagcaatcggaaagattcggacgatgaagaaggctttgaagcacttggatgaagaattcaacacccaatatcagaaagtcgcttatccgcttcacgtgatggtcaccggcaccaataacctgccagccgttcaaaaatggtgtgcatccctgaagcccaaatatcccaaagccagttttcaagttggccagatcggaccggtggttggaactcacatcggctcgaacgcatttgtgatcctatggtgcaagcgggtacctgaattaaccgtttgaaagcggttaggtgttgcctcttgagtaaggtataatagtcttaatactcaaactcgttaacagtattgaagggagaaatttcatgcttagttattttgcactcatcaccctggttaagctgtcaggtttgttaattccatttatctggctgctggttatcgcagaccgccggggtcgaacgtacggaacactagccattgtgctattgttcatcgtcagttacattaacacctacttcaacctgccggatcttgcgtatccgtctttgatcgatggttggttgatgtggttcatcttcggaatgattgttgtcgctgcgctccgccgctttctgtattcaccacacgctgctgttgctcgaacagcggaagccggcgatgggatcgttggccaaattgttcagcgattcaccggcgcatttggctggttgggtaaaatcgccatggtcgccgttcttgccgtgatcgtcctcatcatcctaggcagtattacatccctggtcaccaagatgaatccacgaccagccgttcaatcaatccaaacggatatgaacgatgacaccaagaacgcgccaatgcccgtgatcaaaaacagtgccgaaacgcctgtagtgaacgcaccacaaacgatttcgaccgatatgaataactcattgaatagttttaagaactccaacgtttatgatttgaatcacatgcgggttcagatttataagggcaagatgatttatgttgcccctgtcgaattctccggtggcttctggcgttatcttcattacttgaaagtgcctggttactttagaaccaacgccaccgacaagaatgccgatccaaaatttgttgccaagccgatgaagtacacgccaagtgcctacttcaacaatgatgccgaccggcggatcagcgcccacagtttgggctactcaatggttggtgcaacggctcaattggaaattgacgataacggcacgccttactatgtcagaacacttgccaaaccaatttcatacttgaaccgaaactatgactttaaacactataaagtcgctgttctgaacacgattaccggtaaagtgaaagtctactcacctaagcaggtgccgaagttcgttgatattgcggtcacccctgaatttgtcagtcaggaagtctcaatgtttggccgttatcggcacggcttctggaacgcaaccagctttggaggccacagtggcgttatgaagccaaccactgccggaactgaaggcggcgacaagttgacgccttacgcttacaaaggccgtgtctattacttcaccggtatgaccagtgtcaacgaacaccagagttcaattcttggatatactttcgttgatgcacggaccaacaccctgcactattatcgtgagcatggcaatgttatgacgcctgaacgggcaatctcttatgcccaacaggatatcaacccccagaattaccgcgggacattaccgttactgtaccgaatcaatggggaccccacttgggttgtctccatgcttgatcgggataataactcatttatgaaatacgtttatctattggcggatggtaacaaccaaagtggcacttacgcaattggcgacgatgcccaaagcaccttggcaatcttcgaacaacgagtcgaggcaaagaccggggttgcagcatcggttccagccggtaagaccgtgagcgggaccatcaaccgagttgttcgaacggataacagtttactgttcattttgaagaacaacaatcaagtttataagattgataccagcgccaagaacttcaacccattgctgcagttcattgcggaaggcgatcgggtcagcttcaaggccgaaacggttaccggcaatagtttggcaaccgcaaatgtttcactatcaacctttaaagatacatcattaactgctaagaaatagtcacaataaaaaagtcttcatcgaaaaccagttttcaaattggtttttgatggagactttttatgatgctttggcagcccgtttaacaactttatcatgttccaatttctgtgcccaaatgttaataagcagagaaataatcatcaaaatcaacgacagccacataatattgtgaaggccattatacaaaatcattctcatttgcggcagtaagtgctgcggcaaggaaccgctactggaggcatcgcttaattcgttcatcattttcatggtaatcgaaccgccagccttactgacaccatcacgtaaggcattgttcataatgattccaaaaattgaagccgtgaatgtctgactgagcatccgaatcaagaaactaaacgaagtcgcaatcgggatatccgtcgggttggcatcttgctggactttaacttggagttcattaaagcaggctccgttcccgaatccttcaaaggcgccggcaatcaatagcacccaataaggcgtttgaacgccagagatgaccatgatgataaaggaaatcattaacatgacgatccccatggcaattacccgttgtggcgacaaaaagttccggatgggggcaacgacctctgacccgataaaatcggtaaaggcaccgggaatttgcgtggcaccaccaatcagggcaggggttgccaacaacccttgcgcccacattggactataaatcaggaaggcaataaacgctccccagattaatgtgaacagaacaaagtcaatcatcaacggcaggttcttgaataatcgacttgggataatcggatcgtcgacattctcttccaaaatccccatgacaatcaggacaataatggaaaatccaatcacggccagcaccaaaatcaagttggcattgccgatcatttcaattccggcaagcaaacccaccaatccaatagtcatcataatggctccccggtagtcaactgcttgggtctggcgagtttcatgactgactttgtaatagatttggaccaaggcaattgagatcaggccaatcggcacgttcagataaaagacccagtgccaactaaatgtatcaacgatataaccacccactagtgggccgataatcgtggccatgctataactagcagaaacaaatcccaacacctgcattcgtttgcggggattcttgtacattctggcatagataatgtatggcagcgaaaccgttcccccattaccaattcccatcaaggttcgggcgagaatcaagaagacaatatttggcgccatcccttgtagaaatgagccaaccacaaataaggtggctgctaactggtagctgcgcttgttgccgatgtgttcccccaatttactccataaaggtgtactgaccgcggttcccaacaggaaaacggcgacgatccaccccattaattcaattccgtggagatcggatataattgctggtaaagcagtattgatggttgtgttgtccagtccactcattgcgtttgacagcaacagtgcacaagtcacaatcatgatatcgcgtttagacaagatattctcctctttcttataaaagtcactctttctatactacaacttttataccagaataagaaagtaagaatttcaaaaccgccgaactgtacaaaaatatcttcgacacttctcccctgttggatcgccaaaaatgataagcttgagtcatcaaaggagggttccaccatgaataatctcgagcgaaaagccaaacatctgctgtatcacccggacgttccggaattaatggatcgacaacaggaatacctggagaaattgtattcatttaacatgacatccccaaaagaaaccgacaaacgcaatcagttgctgactgaaatgtgcgcggaagtcggcgaaaactgctacattgaaccgcccatgcacgctaactggggcgctcaccatcttcatttaggcaatgatgtgtacatcaatttcaacttaaccttggtggacgatgatgacatcaccattggcaatcactgtatgatcggccccaacgtggtaatgagcactgctgggcatccggtcctgccgattctgaggaaaaacggttaccaatataatttcccaatcaccataaaagataacgtctggatcggctccggtgtccaaatcttaccaggagtcaccattggcagcaataccgtcatcggtgccggcagcgtggtgaccaaagatattcccgataatgttgtcgcatatggtaatccttgtcgggtggcccgatcgattaacgatcatgataaggaatattacttcaagtcgcataagttggatgtctgggagtagccttaaaaacataaaaatgccagttagaaactgatgatcatcagttttctaactggcatttttggttattttaattgattatttgacggcatcaatgacaaacagctttgaattaaagtcagccgactgatcagttccgtgcgtttcatggagaatgtcacttacaaacaatccagcgttcatcaactcatcgccgtagaactgttcgctgccaccattaacggtgtacttggtgtcagggtcgagccctttaaggtacaagcggatgtaaccggtgtttggtcgattcaaaatttgataacgcgcagcgattgcgtgcttttgatcatcgctgacgacttcccagctcatgacgttaccgccattggcaaatgggttatcgattcgatagaatttcccaaactggaagagttggcgatgttccttgtagaaggcagtctgttctttgacctgttgttgttcttccggagacatcttggtaatatccagttcatagccaaaatcaccgaagtaagcaacattggcacgggtcttcaaagaagtgatccggccgacttgatcatttggcacggctgagacatgggcacccatcatcgtttgcgggtaaccataagatgtgccaaattgaatcagcatccgctcaactgcatcggtgtcatcgctggtccaagcttgaggagcatagtacatcatccccaagtcgaagcgaccgccaccagacgagcaggattcgaacaggacatccggataagctttgaccaagcggtcatagagctgataaacaccgagaatgtatcggtgcggcacttctaattggtcgtcagcactgagctgactgctgtaagtctcggtaatgttgcgattcatatcccatttgatgtaatccagcttggtcatctcaatgatcttgctcatggcatcgaagagatagtcgacaacttcggaccgggtcatatcgagcacgaactgctgacgctcaggtgaagcgtggcgtccgggggcgttgattaaccaatctggatgttgcttatacaactcactatcaattgaaatcatttctggttcgaaccacaggccaaacttcaatcccaagtcatgaatcttttgggtaaacgtcccaaacccgctcgggaacttcggctcgttgacaaaccaatcacccaatgagctgtcgtcattgtttcggtgaccaaaccagccgtcatccaagacaaacatttccagtcccagcttcttggcggtggtcgcgaagcttaacaacttgtcttcatcaaagtccataaaggtggcttcccaattattaatcaacgttggccgctgctcgtgggcaaatcgtgggttaaccaggtgatcttggtagaaggcgcccatttgctggcttaactggttcattccagcatccgtgtaactgagaacagcttcgggagtctggaatttgtcgcccggcttgagattccaagcgaattcttctgggttaatccccacaagaacccggctggcatcatactgatcaacttgaacctggtcggaaaagttcccggaataaatcagattaaaaccaaagactgaaccctgtgcatcatcagtattcggacgtgccagcatcacaaagggattttgttgatgactggaagtaccgcggaggctgccaacactttgaacaccggagcgtaagtgcgttcgaatcatatgacgttcgcgggcccaggcaccagagaactgaatgaaatcgtagtcggcatctggtaaatcaagctgggcgctggctgccgaattcaacctgagcttttcattaccctggttctggaactctgcgctgcggacgatgacatcttgatggggaaaaatcgtgtagttcaaatgcatcactaatcccaacaatttgtcccgtaatgcaatcgtcaaagtctgggcgtcgtcatccatatcatcaaatgccgatggcagcccggccaagcgttgtttaccgtccaccaactcgtaactctcatacttaaattcagtaatgcggctgccatttgcttgcgcaacttggtaggctgggtaacggaaatcacccttccccaagctggcatattcttgtttaaggacctgcggctgcacgtccttatggtcaagtcgccaaacagcggcggcattatgccactctctggttatcaaattatcgtatgaaggctttgagtgaacccgtttgccataatagatctggccgagttcaccattttccatcatgtgaaaaatgtagctggtatggtccgtctgtaaatgaaacagcagattctgatcttcaattctaattgccacgtttatcaatcccttttcagtttttgttaagcgttacttctgatcactatcgtctgatgattcttcaggtttggacaatgtcagtaaatcatcaccgtggttaacatccccggactcaactgtgtagttgaagtctttgatatctttccagttattgataaccaccataactgtgtcatcatagccggccttcttaattgctgggtcccagaattcaagcaattcttggccttcagtaacgtgctgacccttttgaacgtattgaacaaatccggttccacgcatttcaacggtgccgattccaatatgaatcagtgtcaggataccgttatctgaacgaagtccgatggcatgacgggttgggaaggttgcttcaaccgttccgtcaaatggtgcaaagaccttaccatcagatggtttgatagcaaatcctttacccatgttcccagaggcaaagttttgatcggacacatctgaaagggcaatcattgttccgctaatcggcgctttataggtcgtatctttggcaacttctttaacgatgtcggccattgattcctctccgttagtttccaaatgctcgttccaagtcttttcaagttcatcaacaatcttggcatgttctttttcatccaaggtgactttcttgaagaagatgaaggttccactcaaaatcagtaaggcaggaataccgaacatgaacagcttgaaaataatttgtccatgagttgtaatgtcgctggcagtcgcaccagcagtcattcctgcaagaacggcagcaatcccaacaacccagttggaaagagccccacctaatttatcaagcagtggacgaacagctaaggttaatgattcatcacggtgtccaaattttaactgaccatattcaactgaatcactcaagatcatcaaaacaaccaagaaaatcagtggttgtggaatatagaagagaattgcggcgagcagaaccagtggtaatgatgtgccggcaaatgtgaataagatgattgaaacgatcataatgctaatagataggaagaaaacgttccgacggctgtatttctgtgccaacggtgggaacagtaacactgaaataattccgattaccatgttcaatgaagccaacacagagaattcgcctggtttacccatgatataagtgaagtagtaaagttcaagtgagttggtaatggcaattcctgaggtgtacagaccataagtcaatgataaccacattaactggtcgttacgggctaacactttgaacacatcacgcatccgggtcttttcagcatttttacgcagtaatgaatcgttttccttagttcccatggcaacaacaacagctgacagccaggaaatcaggccaatgatggcaccaaacatgaaccagcctcgcaggtcaccttgaccatggttggcattgattgagaagaacacaaccagcggcattacgataaccccaacaatgttggcaccaatgttggaaccgacccgggcaaacgttgccgttttttcacgttctgcagaatcaaatgagatcgctggaatcattgaccagaaaccaacgtctttaaatgaatagaagatatccatggtgatgtacaaaacaccaaagattaacaggtacaacaatgggttggattggttcaaaccacccatattagtgaataaaatagctaatgtaatggaaccaaccgtcccaccagcgaggatccaaggtttaaaatggccccacttggtttcggtattatcaatggtgtttccaataaatggatcaatggctaattcaacaaaacgtaacagtgaaataatcgtggtgatccaaaagatcattcgatcattttgtccgcccgcacttttatcgaacaagtgagaggtgacaaacataataaagtaggtcgacagcgttgcgtagaacatatcatgaccgaacgcaccaaatgagtacgataatcgagatgtgattctacgaccagtagtaatgttggtattacttgccataaattaatcccccataaaaataaattttaaaaaataattgctatctagaatgtaaacgtttacagttaaattgtcaataaattttattaaaacaaaccaaagatttattaaaacatttaattgtgtttaactagaggtaatacaattcaattgaggagtgaagatggatggcgacaatcaaagacatttcccgactggcgcaggtctcacccgggaccgtctcgcgcgcgctgagtccggataaaagcgaatatgtggcaaaagaaacgcgcgacaaagtgagagaagttgctgataagctgggttataaatactccctagcccccaaaccggacaaaaatcagttgaactttgcgctgatcactaccctcagtctgaaagaagaaacgcgcgatgaatactggcggtttgtccgcagaggggtctatgaagctgctaaatctcagaatatcagtatcaagcgggtggtcaggttggatgaaggcgttgagccaaacgattttgcggcttacgatgccgtcatcgtcgttggcagtctttccaaatccgccatcaacgccattaaatcatttaatcccaacgtcgttctggttgatggcggaagtgatgtcgatgacgttgtcgatacggttgatacgaatttagctcagctaacggataaagccttgaacgaaatgacaccgcatgcccaaacaattggttttatcggcggttcccgtcatgaagtgaatttggacggcagccagggtcgtatcattgatgacgcacggaccctcacctataaaacatggtgttcgatcaaccatcatcagccaatcgttaaattgacggactggactaccaagcaatcaatggatgccactgatgacctgctgaatgaatatggcaatcaactcgacggcctgctggtcgcttccgacccactctcaattggggtgatgaagggcttagcaaaacaccacgtggttcctggaaaaaacgtcaaaatcatcagttttgatgacttggaattcgcttcgtacctgacaccatcgctcaccagcatttggctgcccaaagttgaattggggtacgcagcagtcctgcacgccgagaccctcgtcaagttcccacgggattggcacgtcagaaatatcatccctggcaaattccactaccgggaaacgtttaatcccgattagtcttgcgtccgatccccaatttgtcctgttgaggtacaatgatccgtttccaaatactcttgagaatgatatagccgaagataacaccgaccaaggcactcaagaagaaactgggaatgaacagataaatcgcaccggtggttcccatcatccaactggcaatcggataagcaacgattgcaccaatgatgccagtgccgatcaattcaccaaatgccgcaataatcagtcgattggttttctggaaaagccagccgacacagaacgcaccgatcatactgcctggaaatgccaggatagttccggttcccaataaattacgaattaatgaagtgataaatgcctgggtgactgcccaccatgggccaaccaggacaccggaaatcaaattgatcaaatgctgcatcggggccactttggcaacgccgacagtgaactcaaacatactgccgccgaccacgccgatcgcagatagaatcgccgttagcaccattttataagtcatatttctgtgcataaaaagcctcctttcgttagataacaaaaggaggcttttggcttcttttaacacttccctacgctggcgcaaaccagatcaggttcgaagggtccgaagatgttccgtctcagccgattggctcccctaatgttatctgatatttaatttcgacacttcattaagtataaccgaaaacagaatgcttgtcggtcatttagccccttaattcttcgaccgttgtaagccggcctgatgaacggcttcgatcactggggtaatcggcattcgctgtcctgtccactccaaaaaggaaccggcggcttgattcaccagcatcccaatcccattatatgtacgactcccgcgttgcttggctgcatggatgaacggcgtttcgagtggaaagtaaatggcgtcggacacaatgtgttgcggtgtcaaatggttcatcacggactgactaactggcagcgattgatcgccggccatcccaacgttggtcgcattggcaataatttggctttcatcaaacgcttcggcaatcagcccttcatcctcataaggcaggacagtgacgacatccgaccacccttccaactgttcttttctggcttcaaaaagatcgttggtccgtttaaatacataaacttgcttcgcccctgcgtcgacggcagcggaaataatcgcccgcccggcaccaccggcacctaaaacggtcacgaccttttcatcgatggtcatatcatcctgcttgagagcatctacccagccttgcccatcggtactgtcaccaatcagtcgaccatcgcggttaatgaccgtattaacggcagataggcgctcagctcgtggggtaatttcgtcaagcaatggcaaaacgtcggtcttcagcggcattgataaattaaaaccgccaatgtgcatcgcccgcatcgccgccaagctgtcggcgagcccggcagacgtcacgtcaaaggccaaatagatcccgttgatccctgtcacttggaagctggtattgtgaatcaacggcgacaagctgtgagcagccggatgggctaataagccaaataattttgtgtgtccatcgatcattttaattcctcccaaacgacatcttcaaaatgccctcttggttaatgacgtcaacgacttcaaggggcgccaaatcatcggtggcgattcgaaaatcactcacctgttggtataaagtgtcccgttgacctttcaaatccaccagtccatccagcccgagctgttgagctaacggccggtcggtatcattcttcaatcggtcaatgattgtttccggcatcacatcaagaagcacgactgggacatcactggcctttaacaactcaaagttggcagcttgaatcggcgtgccgccaccagttcccaagatcccatcatctgccaaagacgctttcaaagcatcatgttccagctgccgaaatgccggctcaccgtcatcagcaaaaatctgtttaattgacttgccggccgtttccacgatgacatcgtccagatcgtgatatggcaagccgagtttctgtgccaataagttgccgacggtggttttgccgcttcccataaatccaaccaatatgagtttcataggctttctccttaatcgtccaaggactttctaattttttgtgctttggcgaaagcggcataaatcgcagcttcgtcttggtcttgaatggcttgttcaaaatgacttaatgcggtttgaaaagtggccaattcctgcgcaattacttgggaattgctcatcataatcgccgtccacatttttggatccgacgcagcaattcgggtcgtactcttgaagccgccggcagccgcttttaagcccactggatcatgggccaagccgtccgcgacgctgttaaccagggttgccgcaaccacatgaggcagatggctcagttcgctaaccagtttgtcatgggtttccgctgttatctccgtccaatcaacatttgccgaatccagcagctgttcaaagtcgcgaagttgctgtttggtttgtgaaccggttaccaggaagtattttgaaccgttaaataaatcagttgagccattccggctaccggtcaaatgtgaaccagccatgggatggccaccgagaaaagcaactcccttatgtgtcaggcgcttggcttctgtcataatcgactgcttggtactgccgacatctgtcaccaagacctgctcctttaattttaattgggccaactcatcaatctgcctcaaaataaccgataccggacccgctagaataatcaagtctgcttgtggggctgcctgagcgaagtcagcccgctgatcgattatttgatgatccaacaaaaactgggcggaattgtcatccgggtcactgccgatgatctcaacagttgcatccccagccttgataattcgggcaattgagctgccaatcagccccagcccactaatcaaaactgttgtcatcagcactcacctcgcaattaaagttgccaaatcgtcaaagaactccggataagaaatgttaatgctgtctgcaccggtgagagttaacggctgatcaaccaacagcgctgccactgccatcaccatgccaatccggtgatccccatgactgtctaatttcgaatccaaaacctgccatggttttctgccgtcaatgatgaagccgtcatcgagttcttgaatatcaattcccagcttccggaattcagtgacgatggctgaaatccggtcggtttctttgacccgcagctccccggcaccagtaattttactgatcccgttggccttggctgccagtaacgcgactaatggcaactcatcaatgactgctggaatttcatccgccccaatttcgattggttttaactcggcagcttccaccgtcaaatccgctgtcggttcgcccgtactttgttcgtttgataggctgatcctgccgcccattcgcttcaaaatcgaatatagaccggttctggtgtcgttcatgccaacatttctcaaggtgactttggaacctggcactaagctggcggcaaccatgaagaacgctgccgacgacatgtcaccaggaacattcagggtaatccctttcatgtggggttcaggatggacggtaatcgtcacgtcatccgattcagtttcaatctcagccccaaatgcccgcagcatcttttccgtgtgatttctggtcggctgcttctcaaccagaatcgagaccccatcggcttgcaaagccgccaaaatgagggcacttttgacctgggcactggccactttcagatgatagtcgacaccgtgtaattgttccccgttaatcacagcaggaagatggccatcggtcacttcgatgttggcacccatctctgccaaaggttcactcacccgtcgcatcggccgcttggataacgaagcgtcaccggttaattcacttggaaagttttgaccggcaagcagccccatgatcaaccgagtggtggtaccggaattgcccatatcaagtggttgttccgcctggtggagtccgtggagaccaacgccttgaatcgtgactgtgtccccatctcgggtgatcggcacaccaagttgttgaaacgccttaagcgtggagaggcagtcttctgcggttagaaagtggtgcaaaatcgttgtcccttcactaatggcgccaaacatgatgcctcgatgggaaatactcttgtcgccgggaacggccaattcaccgtgaaggccgttttggagacttccttggagctgtttagttgattgcgttttaactttttccatagaaacctcctagaattttttcagttcatcgcgatattggtcaagctgttcttgtagtcgttgtaaattgtcaccatcaaacttgtcggtgagtgccttggccaactcaatggcaaccacactttcgatgacgattgatgctggaacaattgccgttgtgtccgatcgctccacattggctttcttaacctctttggtctggatgtcaacactttgcaatggtttgtacaaagttgggattggcttcattgccgctttaacgataattggcattccgttagtcatcccgccttcaaagccaccgagatgatcggtattcctgaagaatccttggtcctgattccaatcaatttcatccatcacttgactgccgaagctggttgcagctttgaaaccatcgccgatttcaacgcctttcatggcattgacgcccatcacggcagcagccaacttgccatccaatttggtatcccagctgatgtaactgcccagtccagccggcacgttggtggcaaccacgcggataatgccacccagggtgtcaccgtcacgtttagtttggtcaatcagatcatgaatcgggctaaccttggactggtcaatgattcgcaagtcgttttgactaatttctgcttcaattttagccacattaagttcaggattttcatcggtggaaatttggccaatctgttcaacataaccaacaatattaatgcccaactgttgtaaaagttgcttgcaaacagcaccgattgccacccggattgccgtttcccgagctgacgagcgctccaagacgtttcgcagatcctcatgccgatatttcatcccgccaaccaaatcagcgtggcctggccgaggacgttcaacctttcttaaggtgttctcgggcgtttcgggactaattggatccatgatttgactccaatgggcatggtcgcgattgttgactactagtgcaatcggcgaaccaagggtaatcccgtggcgaaccccgccggtaatggtgacttcatcatgttcaattttttggcgattgccgcgaccgtagccgccttggcgtttcttgagttggtcgttgatcgcaccaacgtccaaatgcagccccgaaggaatgccttcaatgataccggtcaattgtgggccgtgagattctccagctgttaagtaattcatcatttagtctccttttgcattaattcatgttggtaatcacgtgagtttttcaaaatttcttggaatatcttttgcagatacttgcgggtgccaggatccgaatccagctgtgcaacctgattgaggacctctctttcacggtcgccatcgagcactggcagttgggaattttccttgatctgtccaatcaacgccgacgtttggaatcgctgcttcagcaggtcaacaatgccttgatctaattggttgatttgctcgcgggcagcttgaattgcctggttgtcactctcagttgctgtttcaattttatttgtcatcattaacacccctaattgccattaaaaaaaccagctagatatggtatccagctggtttactaaattcgtaaagaatgataactcacccagccagactattacgtctagtgggctcaacaaagcattgactctgcaccacttggacgcgaacgctcaaatttgcgcccgccccgaagcggacactacttaaagtaggcatagtcaaaataataggctgaagtttcagtgaattgctttgtcatggttatcaattcctctcgtaaaagttgtattaattaaaacatattagaaattattcgtcaaccctaatcattcactcatttgattttaattccagaagatgctgccacttttaaatagcagcactgactttacttggagcagattgtcgctcagcagcagtggcaacagcctgttcgtggacacgggtaccgttttgatagacgtctttgtcgtgttgaatgacactaatatcattaatgggattttctgccatagaaataaaatcggcgtagttgccggcaacaatttggccgtactcatcgtcaacgtgcatggctctggcacaattgatggtggccgaatcgattgcttgagcaggggtcatgcccgccttctcaacatataattccatctcgtaggcactttcatttctaaagccattgtatggtgtcccggcatcagtgcccattgcgattggaatcccggactgaacagctttggtgatgctggcaaaatgcttcttgatgttgacaatcaccttttcgcgagcccaatcaggaaccgtgtctttcccatatttgtagatggcgtacatcgcgttcatggttggaaccaccaccgtgccgtgttctttcatcattgcgatcgtctcatcatcgatatcaaatgcgtgctcgacggtatcaaacccggctgcaactgcctctttaacacccgcgttcccttgggcatgagctgcagcagtcttccccttgtggtgggcttcgaccactgctgttctggcctcttcaggcgtgaactgaatatcatcaggcgtttccccatttttaaggacgccaccagtcaccatcattttaatgttgtcgacaccattcttcatggcctggcgaacgcctttacgaacctcgtcaacgccgtcaacttcataacccccaccggatccatggccgccggtaattgaaaatgccttgccggatgtcatcacctttggccctctgatccaacctttttcctgcattttcttgacttcgatatcaatgtcaaaagccgcaccaacatttctaatgtaagtaatcccgtgatcgattgcatcggccatgtttctcacggcaaacatcgtattaaattcccgtgaatcggaatggcgctgttctttgccatcgttccaccaataggttggaatactggtgatatgggtatgagcgttcatgattcccggcatcacgtacctgccgtgcatatcggaaacttcatcgacaacttggtttgtggaactgccattgccaacttcaacaatcttgccggtatccgtatcgacgaccatgtgttggttagcgataaagttctgcttctcatggttgtaaattgcgacattcgtataattgatttttgtcataataaatcttcctttcgatgtaaaatgcttggttgcagactaactgagatggaacatctttagatttcgttaactggtatgccatggcaaccacctccttaagtgggattttctttttgaatcaaaactgaatttacttttcgacagtgtagtttggttacacaaatggaagtttgcgatcaagtgcactggcttggaacttagtattctgtcacccaagattcagatcaaaagcacgtttgttagcttcttgcgtgctcccttcggctttgaaaatacgctccgacgacccaagcgctaacttctaagtgcactttgcttaaagtcccaaacacagggacttcaaacaaagtacccttagaaaccgcgcttcccgggtctcgtcgcgctctatttccaatacgcatactgcaacttcccggactggcccgacattgcatcccacttcaaaccgccgaccttgctgctgatcagatgtgcctgcgaggcttgataggttggcgctacggctgcgattgacatcaagcgcttatctgcctgcttttcaaagtcccaacgctggttggcatcgtacttagttgtgtcatccactttattcatcaagtcatcatactgttgatctttgaatttcgagaaattaatggtgttattgctgcgcatgccgtccaagaagttctgggcatccggatagtcaggtccccagccgaccgtacaaatatcgaaatcagttgagaaatcacgcgttacgtgggtggcatgcgggaccgattcaatattgatggtcaggcccttcagattgtctgaaactgctccttgaacatattcagcgagtttcttttcggtatcagtatcatccaccaggaaatgaagggaaatcttgtctttgccaatttccttctgtgcctttgcccaatattgcttggccttagtggtatcagttggtgcttgatcgcccatttccgaggtgaaatccttaccggttttcggatccttagcatagttctttggaatgatgttgttagcaccaatcgagccatcttgaaggacatcctttgccaattgatcctgatcgatgaccatgctgatggcctttctcaagttttcattggaagtggctttcttcttatcattgaagtaaatgtaattgtttcggccagtttcagttaccaccagatttttgttgttcttattttgtttaacgtattgtccagtcaaactggtcaaatcaatttgtccgccgttaaacatgttttgcgcggtgttattgtctttaacaaccgtcacatccacttcaggaattttgacgtttttggcatcccaatagttcttattcttttcatatttccaagaatcattactgccgttccagccagtgatggtgtatgcaccattggccacggtcgtctctgaattagtgccataatgactgccatattttttaatagccgccgtttgaatcggatagaagttcgtaaattcataattcatgaatggcaccggcttggtcaatttaaccgtaaatgttcggtcgttaactgcatgaatccccagcttacttggatcggccttaccgttgttcacagcagcaaagttttcgatgtattgaatggatgtcgtctgctgggacttagttttcggatcagcctgccggtcaatcgaattgacaaaatcttccgacttgataggtgaaccatcctgccatttagcatccttcttgatattaaacgtgtacttcgtgccgttatcagttggtttgacaacctcatcaaccactccggcagcaattttgttattcgcatccctgcgataaatgccttcgctgacctgatcgatcaccgcaccgccattagtttcaatcgacttggttgggtcaatcgtcaatggctcccctgggattgttatttttaaggctttttcggcacttcctgcaccgccgccgactgctgtcgacgcacagccgcttaataagacagccatgaacccaatgacaacactgataatggctgtaaatctaatatccttaaacatcgcaattcctccaataattttgtattgatatcgatgaccatacagccgcgcttgtgtccatgaaacacaaaaagcgtccaatcagaagttaaacttctaaaaggacgcttttgcgcggtaccaccttcattgcggaaattcattccacctctcacgtacgaccggtcgactcggtatacgttggcgctgtattgggcgcaccctagtgactcttgacgaaccaccgtgctcaaaattgactttaagtgattaagaaattacgccttcacagataacgacgctctcttggaatttcttaataccgacttttcaatttctctaagcactttctcatcgatatctaatgtcatgtacaataacgaattctggaaaaattgtcaacacctattcttaaaatcaacactggtgaattgatcgttttgaatgtcacatcaccgtgtcatcaaggcttaatcgcatcgaaaaaatttcaaaaataagtttgattgacttcccacaaaggcaatgtgaaaatgaaattgaaataaaatttgaaagtaatttggggtgatcatcatgatcaacaaacgcgcattattaacgttcagtatcgcagctgcatcgttattgacattcagcatcagcaatcattcagtcccacaagcacatgcagcgactacattaacctatggcaaaatcaccaataacagtctccaccgtctgggcaccatccgccaattgacgcgcgcccaactggctgaagatcacaagctgtctggcaagcaggttcaaaacttgatttacctgccgttacccaagcgattaacagcccataactttactttgagcaaaacggctttaaccattcatctggttaaaaattcatatggtgtcaaagacgtcgccattccattgagtaagttaaccggcattattctcaatcgctacatgccgtcgcaatatgactttgtcaaaccgaaaacacccaagaaagtcgttgctttaacctttgatgacggtccggatccgacattaacaccgaaattacttaaaactttaaagcactataacgtccacgcaaccttctttgaggttggcagcagtgttatccgctatccaagcgtcagtcgattggttctcaaatatggcaaccaaatcggcaaccactcttggaaccatcctgatttaaccaccctttccagtgccaaagcaattcatcagattgccttgaccgatgcagcgatttataaggccacgggaacaattcccacctatatccggccaccatacggcgccgttaacagtcggattgggaacttgtttgaccggccaatcgtccgctggaatgttgactccagagactgggcatatctcaatacgcctaaaaccgtcagtcatgttctggcaacgactcaccctggctcaattattttaatgcatgatattcacccgacgtcagttgccgccgttccccagattattcgatcactgaagaaacggggctacacatttgtgaccttgccaacgctgatgcaaaaaccattgttggctaacctgcagtactttggcagaggagatttccgcggattttaactgaaattagcagcttcccgatatttgggaggctttttttgattgaagttgcggtcaccgcttgttagaattgggacaagattttaatacagaaaagagaggttgatgagatgagtggaaagctaacagttcgacgaacgtcatttgtaaccggaaccaccaaaatagcggtgccgatcaccggtcggaccgtcaatgatattctggcgcaggcccaagcagcagtaactgctcacccggacgtcattgaatggcgcatcgactatgatcaagctggtttggatcccgccacttatcaagccacctacgccaagttacggcgtattttgggcgacacaattctcttaaccacctttcgaaccgctggtgaaggcggtgaagccgaccttgatgaagcagcttatgtgaccctatataaacggttgattgccaatgagttgacggacatattggatgttgagctgcatttcagcgaagaggcaatcagtaacctgatttacttagcacaccaacacaacatcaaggtgatcttgagtgcccacgaattccaaggtaccccgccggaactggagattatcaacttactgcaacagatgcagaatcaaaacgctgatattgccaagatcgctgccatgcccaacaaattcaaggacgttctcacaatgatgcgggccactacaaccgaatcagacaagttggaaattccaatcatcgcaatttccatgggcagtctgggaagaatctctcgagttaccgcgccattgtttgggtcggtgatgagttttgcaacggtcggtgatgcatcagcccccggacagattgcgattgacgatctgcgaacagaaatgaaacgatttgaaacacaataaaaggaaaccgcaaagttgcggtttcctttttgtctgacaaactattcatcttttgagcggccctgactaattggtgccggtcccatatgaagaagggtcatcatcgactggccggcatgggcgaagacgttcccagtactgatggccaaggcagtcacgaccactaaaaccgttccaaccaagccaatcatcacatcaaaattcatcacagattgaagactggttttcgacaagattccggtcacaatcggaatcgtaaaggttgcgatactgccaaacgtaaagtaagtcccggtaatcacacccttatgctttggaaacattttcaacaaaacgttcagggcaatttgcatcaccccaccggctgcggtgaagccgaatatgaagcaggcaacggcggtgacaatgaccgttgaggcatgggtcaccgtgagaattgcgatgagagaaattgtattggtcaccactaacagtttcgtttcggtgaaattcaattttaacaggataaacatcacgaccacaccactgattgaaccgatactgtacagcgacaacagaccgtgggaaatcaatgaactgtaaccaaggtcgttggttgcgaatagactaatccattgggtaaataaaatcatgattgccatggttgtgtaaccgtacaacgcaagggcaatcgtcgcaatcactcgccgaactttggaaagtgattggtgttcttcactaaactcttcatcaacctggttccgatctggaaagtctgcgccgcgaagaatgaataagttgacgactaacaccagcaaggcgccgatgaatgaccaaccaaaccataattgatgagcttccaaagtagcaatgaacagcggtaagatgaactcacccacactcataaatgctttaatgaaaacattcgaggcacttgaattaccgcccatttccacaaaagtcgggtaagttcctgaatccagcgccgaattggctactccggcaataattgcaaacaggtaggccatcgcgatattgtgggtaaacggaatcccgataaagaataccatgtagctgagggtcccggttaagaccaacttttcccggccaaagcggtctgagaggtaaccgaagatgaagtaagcaattaatttcccgattccaatccctgaaatgacgtaggaaaccgtcgcaatcggcacgttccaaaagccacccagagcctgcatattctgggttaaaataatcaacccaattccgtgaaccaggtagttgaggtataaggccattgataatctgcgtttattagattttgtcatgatatcactctcccaagtatgtaagtaaacaaaaagccagctggatattagaatccagctggctgatttcttattctaagaaagaggtgggtgatacattctcaaatgttctcacaaagcagcggctgatcaacgctaatatcctaattaagtcaactactctaccagtttccaagattatcaaggaggtagggattaaaaaccggacctttttctataagaaatatatcagttactacaaaatggcacctggatcaagtcggaaagaaaattcaaactaaatagttttacgaattaagacgtctgtttaaccgctaatttaccaatatttactagtttttagtaaactaataacggtgttaagcagacgccttttcatttacccagaaaatagctcggattgttcaagagtcaaaaaaagattgtgaagtcgtatcgctttctgcctagtttatgtatcaaatgtacatatctgttgctaactgaataatttctcaaatcacgaataattccctacatatcaaggcttacccccgatataccaaatttttattatagagattgtaaacgctttattgaccgatctgggttcacaagataaccttaatacagttgatatatcagattgatataccagataactgtttttgcaaaggaggttacgaggttcgtttagttaacgaattcagaataggagatttaagcaatggcaaaacaaagtaaagtttataccccacgaaagatcaccgtctggcgtgggattggttatgggattgttgattttgtcggtggtggttcgatgaccatcatcggtgcgtggatgctatttttctatacatcatattgtaatttaactgccgttcaaggggcctcaattattggtgccgcccgggtagctgacgcaatctgtagtttattgatggggagtctgaccgataatttttataagacgaagttggggcaacgatttggtcgccggcacttcttcttactaatcggttcgccacttatgttgctctacattacgctgtggatcgcagggatgaattattggtattacttcgccacttatatgatttttgaagtcatttccagtgcgatgatgattccctatgaaacattaccaaatgaaatgacggatgattataatcagcgaaccaaattatcatctgctagaatgttcatctcggctggggcaactttcttggcaacctttattccgggacaattatttgccatcatgggtcagcatagccccatcccgttattagtaaacggaacgttatttgcgattatttttgcaattggcgtttacgtttgttacgcggttacttgggaaaaaccagttactcctcaaatgcgcgcagagcttgagaaagattcagtcaatgaaggctcattgcttcatcgcttctggggactcctgtgtgactatgggtcaacgcttcgaattaagagcttcagaaagcatctgttgatctatttattctcgtttactggaaaagataccttcaacactgtgtttgcttacttctgcatttattgtctgggactttcagcgacggttgcagccaacatgctatcactgtcattaattgggttggtcgttacaatcgttgccggatttggaatggtcaaatacggaccgaagttcttgtatgaagtcggttacgggttaatgctgttgatgcttgtgggttactatctgatattccagctgcacgtcaccaaccatgtgatcttgattttattcttcatttcactgttctatcaaattgggcgggcaaccttggaattcacaccgtggaacgtctttccattcattcccgacttggatgaaattgtcactaaacgtcgacgtgccggtgtctttgcggctgtcatgagtttcactcgtaaatcaactgtcgctgtcgcaacgattgcagttggatttattttggacagtaacggctttgccaagaatgccgccagccagtcgcctcaagctcagcacgccattgcagcgatcctgctctttgggactggcggactgattatcctggcattgttggaagctttgaccttcaaacttaacaaacagacacatcaaattgtccttgaagagattaccaggcttcgaaatggtggtaaaaaggcagatgttgagccaaaggttgcccagactgttactgatctaaccggtgttccttatgacaaagtttggcccgacgataaatgaagttttagagaggaaaataattgatgactaacaatcaacaagaattattaattcctactcacctgaacgtgaacttattacggtttccttacaacgtcgataagtccccaagattcagctggtgggatcacagcaatatttcaaatagccaacaaacggcctatcaggtggtgatttccaaacgccttcatcaattggccaatcaagaatatatctttgatacgggctgggtacaatcctccgaaaatacgggtgttgcaattcctcaaattgagcaggtcttggatgctggggagctgtattattggcaagttcggatcaaggataatttcaacaatatcagtgatttttcccaacccgaaaaattcatcagtactgataagcctcaagtagagccgatccatgggatttgggcagatcgtgggcctaagtcggataatgaactgcccaaattaggaaacgttgtttttattcgtagtccacgctttgatcttaacctggtagatgttgatacggcggttatcaccgcattttccaggggtaatgagccactgtttatccaaggctttgatttgctggtgaatggtaccaacgttggtgttggatcggctcaccgtcaagtccattatcaaggaactgacaaaactgggatttactataacaaatacgatgtcactgaagaattgatcaatggtgaaaacgtcatttctgtcatggcaactgccaagtcgaatcgaaaggccttctggtgcaaactcgaagtctacctaacagatgggactaagaagcagataatcgtgaccgacaaaaattggcacgttttagacggtagcacggcctttggcgattatggtgtaaaaatccgcagcttgtatttcggcatggtgtctgaaaatgttgatttgcgctactacccacaaggctggtcggaggtcgaatataacgatgacaactggccggcagtatgggttaatccacaatcgatggtttccgatgaggaagtttttattccttaccgtagtgaaaatacccggcgatttgaaacccatgagccaagtaaaaaggtgatcaagttaggtgatcaggattacctggttgacttgggaaaagaaattattggaagtcttaaggttaatcttcaaagtctacttaatcaacgggtcacgattttgatgggtgagcagctccaagatgatggacacgttcgtcatcatctagcagctggccccgattatgttgaaaactggacgtttgtgaagggacagaatcaattcactactcttcaggttaaaaacttccgctatattgaactggttggcttccaaggcaacctaaatgaaaatgatattgatggatgggcgattgagcaacaatttgaatctcaagaatccgcctttgacagtgataatgacctactcaaccgcgaatatgagatgtccaagtatacgatcaaagcaactaaccaggatgtttacgttgattcccaagcccgtgagcgacggccgtacgaaggtgatctgttagtcaacggcaataccagtttcgttgtttcatctaaatactcgctcaatcgccatagtatggattacttaattgataatccaacgtggcccgaagattacaagctctacagtattgaaatggcttggcaggattatctctacaccggtaatgatgagttcttgaagaatcgatatactgatttgacttacaagcttaatcgcgggaaaaacgaagagagttttgacggcgcttcacaagactttaaaggatctttgaaaaataccaaaggcgacgacaactttgacgaagaagttggccttgttaccaacgatgggttgattgattggccgattcctgaacgcgatggttttgtcgaaggtgagtacaatacaccattcaacgcaattttctatggcgcttatctgagcatgagtaaaattgctgacgttgttgggcatcacgcagatgccgaccattaccgaagtcgggctgcccgcattaaaaaggaattaattaatcgaatgtatgaccccaaaactggtcgtttctacgactcgatgaataaagacctttcgattaataagcatacatctcatcacgcaacagcttatgcactgtgctatggcgtttataccgatcagcagatggccgataagatgagccgatttgtcgctaatgatggcaaatttgttggcagtatctacttcatttactttatgctcaaaggtttaatcgacagcggtcatgccgatgacgcggtacgtctcctaactaacccagacgaccgtaaagatcaaaagacgtttgcggccatcttgaatactttgaaggcgacgattgcccctgaggcttggagcaatcactataaacctaatatgacgatgtctcatccgtggggagcgacccccggattgacgatcgtgcaagggattatgggaatcaacccaaccaagccgggattcgaaaactttagtgtcaaaattcggccgggcagcctccaccgtgtgagcgttgaaacgccatcagcaaaagggattattaaggccactctaacagtgggaaccgatgaacagattgtcactgtccacgttccaatgaatgcaaagggaacagtgatactgcctgatggtagtcatttaatgacgattcaagatcgtaatggaactgatttggaggggatgcttacgaagactggtcagattgttttaggatccggcaattatcaaatctcatatcgtaccaactaatattgttgtaagttaaatattttgatgcgtccttggaatggacgataaggagaacaggattatgaaaaatctaggaagatattggaacttgagtgtctcggctggtctgggatcgatgcttggttcaggaattattgttggtttggcaagtacgattaccgtctggcagataggactgaatttaaccaacggtcaagtcgggattatttccggtgcgttaacctttgccattgcttttggatcaatttttgggagtcgatttgccgataaagttgggattgtggcaatctttgattgggtgaatttcctttatgcaattggtgccggtatttgtgtcttcgcaaacgggtatctcatgttactggcaggggttgtgatttgtggggttgcttctggaactgacctgccagtatcgttgacggtgatttccagggatgcacctaaccagaagatggcttctgaaatggttgcttcaactcaaattttctggcaagttggtcaatttgtttcaactggtgctgccttcgttgtttctacgatgagtgttactggtggacgaattgtgtttggcttcttcgccatcactgctttgattctttgggtatggcggacattcaccaaaggaattcgtgttctccacaaagaagctgcagaacgattagctgccaaagaagcacaactggacgaaaagccaaccgaaaaagcttcagttattcaggtactctttagaagttcacgaagcaagatttacatccgattatttgctgcaattgctatctactacattttctggaactttgttgccaacacgttcggtcaattcacaaccttcatgttcgttaaagccggtgcctcacagacattatcgactggtattggtttgggactgcacatcgctgcgctgtttatcttaggcttctacgtaacgattgctggttccgcaaaacgaaatacttggttcacccttggcgttatctttgcactgatcgcaatgggtggtctggcaatctttggagccacttcgattgccttgatcgttgccttcatgctcgtttggggtgttggaagtatgctctcaggtgaagctatttacaaagtttggacacaggaatcattccctgaagaaattcgtgcaagtatccaaggatttatcaatggggtttcacgtttcctttgtggaattttagcaatgttcacaccattgttggtccttccaagtactatcaagatgacaatgtggggattcgttggtatcgttgcaatcttcggcctggctggatttgcaatgatccattatgaaaagaaatacaacatgattaatggtgatgaagcaagcaaagctgccgctgctaaagaagcagataacacagctgctgccaagtaactcatttttataattgaaagcaaacaagcgcccagattaaattctgagcgcttgtttttggatcggattctattgtaagtactgatcataccacccagctgaatgattcaaataagtcatcatctcagcgtcggcatttgccccggttaatgtggctatcgtttgtggatcaccaacggtttttggatggttaagtgttccagatagctgatggatggtgactttcacatcaccgttcttttgaaaatcgaagctgagaccaaatttgggattccaactgttgttctcgtacttgtattgggtgaaaccgttcggagtcacataccgataatcagtcgattttgaggtatcaattaagttccttaacttttgttcgtggccgccaatgctgacaaattggtaggacggtgccacgtaccaaatgccatcgcgtaaagttggctggttgttggaaatactgatgatatttttggttgtgacataacgtaggcgatcccgacaatccaccagggaaagatcatggttcgggccatagccgttgccgtataccttggtgataggaccttcctccatattcgaggtggattgggcggttggatcttcaaagtcgtaggtccgagaaccaaagaccgttgtgaccgtcttggcatcgctgtaagtcctgatcggctttgctcgatttggcagtttggagagttggagaactggatagaatgaattaacgtccatccaataatgataaggatacgtttcaatcatcggcagttcaacagtttggccgctgatatatagtttcatcattgagatgcggacccctctagaaacgcgattttcaatcatcttgggaacgtttggattcttctttttaagaaaattgataacctgcttttgttgactagtggttggcaccttgaggtatggcttcattgaagtcgcattcatgacgccaaatacccgcccggtttgacggatgtcgttggaagtggaccagtccttcttattgtatggggtactcgacattaacacatgtttggttggatagcgatagccgccacctttaatgtaggagccgggaactaagctcccatgccaaacgtaacctttgatcttatggttggcacttttgacatagtaataactaccataatagctgctcgtccgaattgtgacccgctttgtcgaataaagattagtgtgtgggtagttcttcagattggcgagcttcttggtgtaactcgcattccaaacgtagactgatttgcgagtgttggtcagaaatgatgtctttttaaatgttttgttagtggtaattttggttttggcactggcggacggtgttgactgaattgaaacgattgaccctgtcagcagccccgcagccaggatggccagcgtgaatttcttgtgcatgataatcccccttcaattattgattatagcgtgtcactcacttgaggcccacatatccggttcgattgatcaaagtttggccatcatcagttctcaaccagctgattagccgttgagaatttttggatggttggtcacgtgaaatggcgtagaaatgggcgatgaggggatatttcccattgcggatgttctttgcagttggcgcaatgccatcgactttcaataatttcacttgtctgttgtgcatcatttgcgtcgcgaaaaatctaaatgagtagccaatcgcattggtccggttgttgtaaccagcgaccccatcaaacacgccgtccatggcgtcaaattcctgatagcgtaagggcttgaccattttgtgctttttcattaccatctgctccatcgccgtttggctgccagaaccttctggccgttgaaacggttggatagaagcaaatcgcccgccgacacttgaccagaagatggtttttcgctgatagatcgattgaatttgtccagttgacagcgtcttgactggatttttttggttcacaaagaagacgaatgcttcggtaccgattttagtcaatcttaaataaacgtggtgtcgtttagcggttctgaattgggcctttgacggactggccatgaaaatgacatcagcttttttggttaacagactatcaaaggctttaggcgttgagtcaactcttaccagctgtgatccttgtttagttgacaccttcggatacagagtttgggcaatcgctgaatacatgggataaagggcggttgcaccgtttaaccgcggataattggcagtgattttgaccgacgttgggtggttcaactttgccagcgatctgctattgcggaatggccggtatttgttcaagttaagcgagtttgaaccgtatgtatcagtatatttcagactatttgcaaaattttggtagatcggcaaaccgctgattaaaaaaatgatgattaatcccatgatttgaccacgatgaagctttggcagctcctttgcttgccactgataaatgaaaatccccaagactgccgaccaaaaggtaccgacaaacatccagccgagattgtggtagaacagcccccatgctaaaaatagggcagaaaggttatatggaaggatggcggctggataatagatggccgtgtctaagtagctgtaacgggcggctgccagaacgaccgtcagtgaaccgaaatagtaaattaaggcaaccagcaatgcccaaatttggcgatgataattggcaaattgattcttgcgattgtagcgataccaatagactgcgttcaagaacaatgccggcagcatagcccaacctgacgaagttattccgtagacgccaacagaaccaacgatgagcggtgacagtaatagtgacctgattagcagccaccacgatgtttttcggtatggtttttgtttcttagtgatgatgagtcccccccttgtgatgctattatcattatagtattcgtaagggttgaggcaaatgaactgtgggaggctgttttggggtggaagttactggggtttctgcttttgagctatgctccgacgacccagggacctactgtacaaaaaagaatcagaccacgatgaataaaacgttcatcatggtctgattctctttggtttccaatcatgtttatgtcgatctttttccaaggaatatcctgtcataggtaggcaggagttatggaattgacaggttccttcggctttcgagctatgctccgacgcaactgatgctaacttctaaaagggctttgattaaatccccaaagtcaggggttttaatcaaagccctcttagaaaccgcatcacccgttgctcgtcgcacactaatttttgaaataatccggatacgcatcgacaaccttttgcttttccagcagcatcaaatgcaaatgctgggtaaccaggaagctcaaatcgtcgatatccttattcttaacggcattaaaaattgcggtatgttggttggttaacgtatcccaatccaattcagtttccttcaaccgtagtcggcggaatcggttgagctgggtgttattaatctgcagccagttccaaaccgtatccttatcgacgaccttataaaaagcgtgatgaaattcctggtccagatcaaagaagttatccggctcattcttaagggcggtctgctgttgctgatctaaatttttctgaatagtggcgatggcctcatcagaaatattgacagcggcgtccaccataatcttgggctcaatgcagctacgaacaaagcgggcatttttggcatctgccatatcaattttagtgatgtaggtgccactctgaggtatcacttcgatcaaaccttcacgttcaatacggatgatggcttccctgactggggttcggccaagatttaactcttgggaaatcagcttctcggaaatcttctgtcccggtacgtagtcgaagtggatgatgcgatatttaatttcattgtaagcgtcactgcgcatattatccaacataataagtctcctttagatatcatcatattagcatattttggtgaaaaagttaacgaagatccttgaaaaaactggggtattgacaatctgatatatcagaatataataaaaccgaaagcgtattcagcggactggtgtactattttgttttaagccagctggcatacgttcatgtttggctcacgcaacgcaatacaggaggtttaattaatggtaaaaattactgacgattacctgaacaatcaacaggggtttgctgacgctggaattaaggttccaacttatgatattaaacaaaaaacgggcgccacaaaatgggttcacttcggtggcggtaacttattccgagctttccacgctgctattgccgatcgattgcttgaatccggtgatttggatgccggcgtggtcgttgctgaaacgcatgacaaggacgttgtccaagacgcctataaaaaatttaacgataaaattctccgggtgattacccacgaggatggtaactttgaaaaagaattatttgcttcagttgccgatgccttgttctttgaccaaagcaatcccgatggttggaacaaactattcaagatttttgaaaatcctgctcttcagttggcgactttctcaattactgaaaaagggtacaacttgtgggacagcaagggtaacttattgccagccatcgaagatgatatcaagaacggtccagaggcccccaagaataacatggcttccctgactgctttgatgtttgcccgctttaaagccggcaaatacccaatggccttactgagcactgataacttctctcaaaatggtgaaaaactcgaaaaaagtgttttgactatcgctgaaggctgggaggaaaacgggttggtgcctgaagccttcgttgattatttaaaagacgaccacaaggttagcttcccattgtcaatgatcgaccgaattacgcctaatccttcagaagccgtttcagaaaagctcaaggctgacggctttgaagactatcaaattttccatacgcctggccacaccaatatcgctgccttcaccaacactgaagaagttcattatctggtgattgaagacgactttccaaatggccggccagccttggacaaagtcgctggcgtcaccctgactgatcgcgacaccgtcaatgatgccgatgagatgaaggttaccacctgtttgaatccattgcacaccgcgttggctgtgaacggcagcctgcttggctttgactcaattgccaaagaagtcagcgatccagacatgctgaacctgatcaaacaaattggttacgttgaggggctgccggttgttaaggatcctaaggttatcaaccccaagacctttatcgaccagttggtgaacaagcgtctgcctaacccatacattccggatatgccgcagcgaatcgctgccgacacgtcacagaagctgtcaatccgttatggcgtcaccatccagcattacattgatgatcccaaacgtgatccaaaagacctccacttcattccactcgttctcgcaacttggtgccgttacctgatggccattgacgaccaaggcaaaccatttgaaccaagccgcgatccactcttggcagaactccaaccaaaggtccaagacattaagctcggcgaaaagaccgacgttcatgcccacttgaaagacatcttatccaatcagaagatcttcggtcatgacttatatggaattggcctgggcgacgttgtggaaggctactttacctcacaaatcagcggggttggtgcagttcgcaagacgcttgaagacacgttatcaaagtacgctaaacaaattaactaaggagacaaaccatgtcattattgaatgatgatttcttattgaccacgccaatggccaaaaagctgttccatgatcatgctgaaaaaatgccgatcatcgatttccattgtcatttggatccaaaggaaatctatgaaaacaaaaattacaagaacatcagtcgaatttggattaacgaaggcaactttggcgaccattataaatggcggttgatgcgcgcaaatggtgtgccagaagatttgattaccggcgacggcgatgattaccagaagtttcttgcatgggccggcacgattgaaaaagccctcggcaacccactgtttgagtggactcatctcgaactgcgccgtttctttgggattaatgatgtctttaataccaagaccgctcctgccatttgggaaaaggccaatcagctgttagccaccgatgattttaaaccacgcaatttgattaagcgttcaaatgttcaagttgtctgcacgactgatgaccccgcttctgatttgaagtaccacaagttgctcaaaaaagaagaagaccaaaatggcttcaaagtattgccggcaatgcgtccggacaaggcgttcaacttgactgatgacggttacggcgattatcttgaccaacttgcaaaagtttccggcaaaaagattacttcatttaagagcctggttggcgcccttcggcaacggttccagtacttcgaaagcctgggcggccgattgtcagaccacggtctcaacttcttccactttgtaaaagcttcagacgatgaaatgaacgatatcatcgacaaagcccgcaataataagcaactcaccaagactgaaatcgaccagtatcaaaccatgctggttgaagccctgatgcatctgaacaaagaattcaactggacgatgcagttccacatgaatgtcatccgaaacgctaacaagcccatgctgaagagctttgggactgatggtggatttgactccatgggaacccagcctgatttggcccaggaattcatgaaactcttgatggatgcgcaggaagaggaccaaatccctaagatgatcatttactcattgaatccaaatgactggatggaattagcaaccggaatgggtgatttccagcaagacggcgttcaaaagctgcagttgggagctgcctggtggtttaacgacaccttcagcgggatgaagaaacagttgacgatcatggctgaagaaagtcttctgcctaacttcgtcggcatgctgaccgattcgcggagtttcctgtcatatccacgtcacgagtacttccgccgcgtcttatgtaatgtcattggtgaatgggctgaacgtggccaagcaccagatgacgaagattacttgggcaaaattgttgaagatatttcatataataatgcccacgatcagttccatttctttgatcgagattaaccaaatcgcagaactagtatgttagtgcaccaacaattatgatttaaaattaaggagagaacatcatggaatacaatatcgcagttgttaattcaaatagttttggtcaggtcttcacagagcattggaaggaattggaaggcattgggactgttaagcggttcatgctgccaaccgacattgacggtaaatctttagctgaaaagcttcacggctttaacgtcattattgccagtgtgaccccgttctttaacaaagaattcttcgataacaaagatgaacttttgttaatttcccgtcacggaatcggctttaacaacgttgatttacacgctgccaaagaacatggcactcaagttgccatcgtcccacaaaaggttgaacgaaattccgttgctgaaaacgaactcgccaatttgatggccttggttcgccaagttgttccttcatcagaacgcgaacgcgccggccgttatgaagaccgtgcccaattcatgggtaacgaattcagtggtaagacatttggtgtgattggctgtggtaacatcggcagccgagttgctgaattgttcagtatctttggtggaccagtcttagtcaacgatccacatccggcaactgaaccggaatggtttaccaacaacaacgttgaacgcgttgaccttgaaactttgcttagccgctgtgattatatttcattgaatgcttctctggatgacaccagccttcatatgattaactccaagaccattaagagcctcaagaagggtgcttacatttgtaataatgcccgtggtgccctggttgaagaagacgccatcagcgccgccatcaagtctggtcagctctccggctacgctgccgatgcaatggaagttgaaccggttaaggcagaccatccattcttgaagaacgaccggatcctggttacgccacatacttctgcttatacttatgaatgtcttcacggcatgggcgaaaaatgtgtcagcgatgttaaggcaattgttgccggcaaacgtccgggacgtgagttgactcataacttggacgattaacgcgttccggttatataaatgacaacccgagaacctgaaacggagaatgtgatgatggattatattattggaattgacgttgggacgaccagcaccaaagcgctgatttatgataccgacggcaatatttatggcaaggccaataagggctatccgctttatcaagacacccctgatatggccgaagaagatccggatgagattttcaacgcgacggtttctgccatgcaggaagtggtggcaaaagccaacataacggatggcaaagtgattgccatttcctggtctgcccaacagcacagcttgattgccttggataaggactttaagccgctgaccaggtcgttgacgtgggctgacaaccgttcccagaagtatgcggcggaatacaaacagaatggccgcgggatggaaatgtacaaacgaaccggtttgccaatccacccgatgggacctttctacaaattgctttattttaaaaatgaacgaccggaaatctttggccaggccgcctattgggtgggcatcaaagaatatatcatctggaagtataccggggtgctcaaagaagaagtctcaatggctgccgcaaccggcctgttgaacatgaattctgcccaatgggacgaggaagcactcaaagaaaccggcctcactgaaaaacaactgcctgagttggttgatacgactgataaattccaaggaattacgccagagtatgccaaagtgattggcattgacaaggacgtctattttgtcatgggcgctactgatggcgcattatcaacgattggtgtcggcgcgattcaaaccggcgtcctggcaatcaacatcgggacttcggctgccgttcggaccttcgtcgacaaaccgcgggtggatcccaaagcccgtttgtactgctacccagtcatgaagggcaagtatctggttggcggcccgatcaacaatggtggcattgtcctcaactgggcccatgattcactgtttggcggtgaagttgaagcagcaaaactgctgcacatcgactcttacgacatgctttcaaagattgctgccacggtgccagctgggtctgatggcttaattttccatccataccttggcggtgaacgtgccccattatgggatgccaatgcccgcgggtcgttcttcggccttaatcgcaagcatacccgcgcccacatgattcgtgcggttatggaagggattatgtacaatctgtactcagttaccttggcactgaaagaagttaccggcgaacccaaggccgttctggctgccggcggattcgcgcggtcaactctttggacccagatgatggccgatatcttcgagcacaatattgtcattcctgaatcttacgagagtggtagtttggcagcgatgtttcttgccaaaatggctttgggattggaagacaaccttgaagacattaagaagtatatgggcaaggaaaccgtgtatgaaccaaacgaggacgtctttaaacgttatcgaaccctgatgccgatttatctgcggctcagtcgcgatctttctaaagaatatgaaggaattgcggagtatcaacgtgaattttcagatactgatgaataattggattgaggcgccaattcgtttctgccggttgcgcgaaatggattggcgcttttttggttgtgcgatgattcacccaatttggtagtgattttggaaaattaaaatagctaatattgtcacaaactcctaacaaatagtatacttttagttgtggttacgttttcatttcgaatggaaatatccaataaaaacaacggaggtactgattatgtccaaagttctgattgtcaacgcaggaagttcatcattaaaattcaaattgtttgaaatgccccaagaaaaggtgctcgctgacggtgaggttgagcggttgaacatgcccggctccaaagtcaaaatcaagtatggcgacggtgaagtctataaagccgaagaagataagattgattacgagcgttcggcggggattatgttgaacaatcttgaagatcttggcgtcatcgatcatttacgggatattgacgcaatcggtaaccgagttgtggctggaagtgacatctttgataaagtcgtcaaaatcgacgatgatagtttgtcacaaattgttgagttgggcgatattgcgccgattcataatccagtcgaagctgaatacattgaaattatccgcagaattttgccggacactgatcagtatgcgatttttgacagtgccttctttaaagacgttccggaagtcaattcgatttacgggattccctatgaactgaccaagaaatttaccattcgtcgctatggtgaacatgggattaaccatggtttcattacacaagaagctgaaaaggcgttgggcaatgaccacgctaaattagtgacccttcatttgggctcaggggcttctgttgctgctgaaaaagacggcaagtgttatgacacttcgatggggttcacgccgatgaacggtcttgtgatggggactcgttccggggatgtcgacccagccttggtacctttctttatgaagaaaatgggtgccagtgctgaagaagtcattgatatgttcaacaagcgttccggcctattaggcgtctctggcgtttcctctgatatgcgtgatttggaagactctgatgatgaccgtgccaaattagccttggatatgtttgtcaaccgaacggttaagtatgccgccagctacatcactgaactcggtggtgtcgatgccatcgtcttctctggtgggattggtgagcatgacaaatgggttcgcgaacaggttgttaagaagctggaaattttcggcatcaaattggacggcgaccttaacgagcagcaaaagcccggcgacttgggcaccaaagattcatcagccagaatcctcttaattccagctaatgaagagttggcaatggtccgggatgtggccgcagccctttaagactcatagatcggtcgattgtttcaaataaaacaaatgaaattctcctcaagttaaaggaagtcctttagcctgaggagattttttggctttcagatcaaaaaaataaaaatcacgaaagaaaattgcgtaattactaattatggcatgcaaagcgagggggaactcagcatgcgcaacggtggcagattctgttacaccgggctgcctgctgatacttttaaacatttcggcaggtagtcaacattttttgagaaagtagtgattttattgattatcaaaagccgtcggtcatggattgaacaaatcgtgatggcgattttcttcctgattgtctacgtcattgagatgctggcatttcaacatacggcaccaattgttttttcggtgatccaactggtttatggtttgatcgtctttgccttcgtgtacgtggaggtgggaacgtataaggtaacaaccacccggttgaaattaaccactaatttgaaggtgtggttcgcaatttttgctgccacggtgatcgggatgctgttactggaagagttgccagcgaccgtcgtcaccactttgacgacccgacacgttgtggttaacactctgattgctctgacagccggattctttgaagaaagtctggtccgaggattggtgttttccgccttcctacaaaacgccaagaaccaccggcgttccctgaaattcaccaaagctgccatctattcctcgctggtgtttggcggcctgcatatgatgaatatgagtcaggacaacatcgaaggcgtgattcagcaagtcgtttatacagtcgtgctaggcctcttgttggttgtgattcgcgtgacgaccaatactttgatctggccgattgccctgcacttcttgattgattggcaacctgatattgcttcgggcgcagtacctgatgcaacgaactggttggtgattatcggcgtctttggtgtcattctggtcgctagtgtgatttacctcgtaaaatttgatcgtgaatatgagaagcagcaagcacagagcacaattggctaacaagtgaatttttccatcaataaagagctccagataaggacggtttcgttcttatctggagctctttgagttgtttgagaaatgtttgattaatgatgggtctagaattcaaccttgtacttaatgctgtaggtcttttcttcaccagctggcaaggtgacatcaccaaagtcttcgtggttaggggtgtctggcaagttttgggcttccaaagcaattgccatgtatgggccgccttttccgcggagatagttggtgccggttaaatcatccggtgtgaagacaaccaatgcattgcgcttggaactgatcgaaatgctgcggccactttcgggatcggataaggttgcgactggttcgtcgtcttgatggtcattgatttcaaagacttcatcataactgtgaccaacttcggccttcatgtcggcgataccgactttgaggttttggttatcgcggaagtcgtatggggtgtcatccacggcgactttcttaccggttggtgtcttgtccttgttcaattcaaggtacttgtcggcgttgatttgaagtgattggccgttgatgctgtcaccctcactcaagttgaagtacatatgctgggttgggttgaacaaagtgtcggcgtcactcttggcactgtaagtagcggttaattcattatcgttattgagtgagaaagtaatcttgacgtcgatgttgccggggaatgaatcctcagaagagtcgatgtgcttggtgaagacgatggtgtcaccatcaaatgatccgtcccagatttgggtgttgaacccgtgggggccaccatgcaaagtcgtggtgccttcgtttgaatcaacgtggtattcctgacccttgatcttgaaagtaccgttggtgattcggccggcggttcgaccgattgcttggcagaagtattgattcttcatcaattcttcactgctgggcacactgaccaaaatattggttggtttgccgtcaggtccgggaacgttgaattcttccagggttgccccaaaggtaattgctgaaacagaaacgttgtgatcgttggtaatggtgaacttttcaatgtcttgaccatctaacttatcgaacaattctttcttggtattcatagcatctttctccttacgaaaataaattacggttgtgaaaccgcttttatctgtattataatatgtttttgtacggtgatgcaataccaattttttaatttatccgtataattctatataaattttactcaaagtatgatatttttattactggagtattttatttaaattcgagaggttatattatgacgacaattttgtatgttttatcggggattaccgatttattaattattgcttttatctttatggcaatgtatgaattcgccagaaaagatcagacgaagcccaatcaccattttggtatctgggcaatcgtttgtgtcttcattacttttggcttgttaatgttaacgtagaacacttatcaatttgaacgcggggggatctcatcatggaaacaaagtacgtcatggtcaagaagaacattaaatcacacatcattaacgggaaatacaagattaacgataaaatccctaccgagtccgagttgatggcaatgtataaggtcagccgctacacggtccgccgtgcagttggcgacttggagcatgaaggctatatttatcgggttcaaggcggcggtatgtatgtaaacgactggatcaacaataaggtctcttctgaccgatccaatcaaaacgtcggcgtggtcacaactcacattgccaattatattttcccaagcatcatcagcggcatcgatcaggtgatctctgatgaaggcttgtcgattctcattgggaatacccatgatgaatatgaaaaagaacgtcataacttattgaatatgctggacaatgatgtggttggcttcattattgaaccaaccagaagtaccttggacaacccgaacctcgacgtctaccagatgattgtcgattccggcaagccggcggtgttcattaacgcccattatccacaattaaatttcccatacgttgaaaccaacgatacggatgccgaaaagactttggtcgactatttgttggatcatggtcatgaacgggttttgggggtctttcaagtagatgatctccaaggcgtccatcgaatgaacggtttcatcaagtcctaccagacccatcccaacgtctcaacttcgggcgatatcatgatgtatcgttccagcgatgacattcatgacgtcttggataagatcaagacccgggttcaggttgagatgaatgccctgccgacggcgattgtctgctataacgatcaattggccattgaagtcattgggatgttaagcaaagaaggcattcaagttccggatcaaatctcggttgcgggatttgatgattatcagatttctcaatatattgatccaacgctgaccacgatggatcatccaaaacgaaaaacgggccacacggctgcccaactattattagatatgttggatggcaaggatggcagttcaaaaattttagactcggatctgattgttcgagcctccactaaaagcatttaatccggcttttagaaaataaattccaagatcacttcgcttgaaaggaggtgatgcacggcggatttcccgtccgtgttttattttccagaaaaattttgtgctaacaaataaaatatatcttgatttatgcgtataaatattttatactctttttgtaagcgatgtcagaaaccgtttacaggtgcgcacaaagtttttgcaataattggtttaataaaatacgaatggggtgctcgttttgaaaaaggtcacaaataatggctttatatatacgtttggagccttaggtggtttgctcttcggttacgatattgcgtcagtttctggtgcgattctgtttattgaaaagcaacttcacttaggaccatggcaacaaggttgggttgttagttccgtattaatcggtgcgattatcggtgctttggcaacaagtaagttcttggatacttatggacgtcgtaaattattgatctgggcttcggttatcttcttcattggagctttaacatcaggatttgcgcctgacttctgggtacttgtttctacccgtgtggtattaggtattggtgttggtattacatcagcattgattccagcttacttgcatgaattggcaccaaagagcatgcatggtgcggttgctacaatgttccagctgatgattatgattggtatcttgttggcatacatcttgaactactcatttgctcatctgtataccggctggcgttggatgttaggattcgctgcattgcctgccttcattcttttcttcggagcccttttccttccggaaagtcctcgattcttagttaaggttggtaagactgacgaagctcgcgaagtcctgatggacaccaacaagcatgatgccaaagccgttgatgttgctcttactgaaattgaagaaactgccaaagcaccagttggcggctggaaagaattatttggtaagggtgttcgtcccgcattgattactggacttggcgttgccatcttccagcaggttattggtagtaacagtgttatcttctatgcgccaaccatctttactgatgttggctggggagttatcgccgcattacttgcccatatcggaatcggtgttgttaacgttatcgtaactgttgttgctatgttactgatggataaagttgatcgtaagaagatgcttgagtttggtgctgcaggaatgggcctttcactggtcgttatgtacgccgtcctcaagttcgataatggatcacacgttgccgctattgtgagtgccttggcactgaccgtttacattgccttttatgcaacaacttgggcaccagttacctgggttctgattggtgaagtcttcccattgaacattcgtgggttgggaacatcactttgttcagcaaccaactgggcagctgatatgatcgtttcattgaccttcccaatgatgcttagctcatggggcttggacaatgccttcctgttctacgcagttatctgtggaattgccatttgggtatgccacagcaagttccttgaaactcgtggtaagtcacttgaagagatcgaacttgaccttcataaggctgccggagaagacgttgcgtcaaacgttacaaaatagttaaccaattttagacattttgtctaaaaataataaatcatcaagaggagagaaaactatgttacaagtacctgattatgaattttggtttgttactggtagtcaacatctttacggagaagaacaactgaaatccgttgaaaaagatgcacgagacatggttgataagttaaatgcttctggcaaattaccttacccaatcgtgttcaagatggttgcaaccactgcagacagcatcactcaattaatgaaagatgttaactacaatgataaagtagccggaattatcacttggatgcacacattctcaccagctaagaactggatccgtggtactaagttacttcaaaagccattactccacttggcaactcaatacttggatcacattccatatgacaccattgattttgactacatgaaccttaaccaaagtgctcatggtgaccgtgaatacggctttatcaatgctcgtcttcgtaagaacaacaagattgtttacggctactggggtgatccagaagttcaagacgaaattgctgactgggaaaatattgctgtcgcttatgacgaaagcttcaagatcaaggttgcccgcttcggtgataacatgcgtaatgttgctgttactgaaggtgacaaagttgaagcccaaatccaatttggctggactgttgattactacgcacttggcgacttggtagaatcagttaacgctgtttctgaaagtgatattgatgccaagtacaaggaattacaagacaagtacgaatttgttcaaggcgacaatgacaaggacaagtacgagcactcagttcgttaccaaatccgtgaatacttcggaatcaagaacttcttagacaaaggtaactactcagcattcacaaccaacttcgaagacctttatggtttggaacaattacctggcctggcagcacaattgctcatggctgatggttatggcttcggtgctgaaggtgactggaagacagctgcccttgaccgcttagttaaaatcatgactcataatcaggctactgcattcatggaagactacactcttgaattacaaaagggtcaagaagctatccttggatcacatatgcttgaagttgaccctggcatttccagcgacaagccacgtgtcgaagttcacccattggacattggtggcaaagcagatcctgcacgtttggtatttaccggccgtgaaggtgacgcaatggatgttaccatctcagactttggtaatgaataccgcatgatcggttacgctgttgaaggtcacaaggctccaaagccaactccacatctgccagttgcaaaacaaatgtggacaccaaagatgggcttgaagaatggtgctactcaatggatccatgatggtggtggacaccacactgtcttgacattcaatgctactgagacacaattccaagacttagctacgatgtttggcttgacgtttaacgatatcaagtagcagagtgtgaagagcaacgggtgaggcgttttctaagggtactttgattgaagtccccgggtttggggctttaattaaagtgcacttagaagttagcctcagttgctcggaacatgtttcagcacagtgtgaagtgagccgggagatgcgttttctaagggtactttgattgaagtccctgggtttgggactttaattaaagtgcacttagaagttagcatctggctcacggaacacatttcagcagagtgtgagctggggggttgacaaccggcttaggtgtaggttgttgccccagggaacacgtttcgactaggtagcctaaaacgaccacccgagtaaccccgagagattactcaacataaagtccaacaacaaagcccccgagaggcttcggacgggacttcataaaactaaaatgaggttgagacaaatttgcgtttgcctcgacctcgttttgtacatagcgcttatatataggaggaaattgatgatgtgtagtgaaaaagagaaaatgttagctggagaacggtacctgaatacggatgacgaattggcagcggaccggcaccgtaaccgattgctggtagataaatttaaccgggttgcccgccaagatcctgagcaagggagccaattgattaagcaaatttttcatcaaactggtgaaaaggtggatattcaatccccctttcaatgtgattatggctacactgtttcagtcggggagaacttttttgccaattacggttgtacacttatcgacgttggtaagattacaattggtaagaacgccatgctgggaccgaacacttcgatttattctgtcaatcatccccttggagccaaggaacggatcgccaattatgaatatcctgggaatgttacaataggagataatctctgggttggcggcaacacgacaatcgttccgggagtcacattaggagataacgttgtggtggcagccggagcggtggttacaaaatcgtttggtgacaacgtcctaattggcggcaatccagccagaatcttaaaacatcttaattaatactggaggattttgatgagtaaagagaatattggcagtagaatcaaattagcagacggtcatacgatgccccaagaaggactgggtgtttatcggatgactgatgaagatgaattaattaagtcggttaaatccgcatatgatgatggttaccggttgtttgataccgctcaaatgtacggcaacgaagctgcggttggcaaagccatcaaagacttggatgttgcccgggaggacatttttgtcacgactaaggttgctgaagagaatcaaggatacgatcagaccattgcttcagtcgaagaatcattgaagaaactgcagttggattacgtggacctactactggttcactggccaattcacacccacttctttgaaacctggcgggcatttgaaagccttaaagagcaggggttggtcaagtcgattggcactagcaactacggcatgctgcatctgcagtatttggcaaccaaagctaatgagatgccagtcgtcaaccaattggaagtccacccatacctctcacagcaggctatgattgatttcgaccgtgaaaatcacattgtcactcaagcatgggcaccgttgggtcgcggccggatttttgatgatccagtgattgtcagaattgccaatcagcatggtaaatcagccgcccaggtcattttgcgctggcattttcaacgtggtgattcattcattcccaagtcagttcatcctgaacggatcaagcagaacgctgacatctatgattttgagttgagcgaagatgaaataaaacaggtggatgggttgaaccggaacactcggatcagccaagagcctgagatggtgtatgagattgggcatcagtatccgcatcattaatgatgaagtctaaaaaggctttgttactgaactgattagcgttcagtaacaaagtctttttgattgggattgtagaaagcgacctgaagttcaaaagtgatgttccgttcctcgagcttgttttttgacagattagcgatataactgaattatgagttagatgcagttctagcaacatacttatctgttgggggagaataacatggaaacgagtagcaggaagttatcacagattttgattggcttattgttcattctaattggcggtattgcgatctttctcaacatcttttcgctgggcccgttaccaatatccaagggcatggccgctgtttattggctgatatttgccggtggaatgaacgtagttggtggaattgttcgcttgtttacatatcgccattccgtgttaataattcttgcggcagtgctattcgttgtcaatttgattcccggtattcagcaggtgatctcaggaaattattttttatttccgatcattgttgtgctgctggttctagcgattgcaatcggggcagttgatttgtgggatcgaaacaaatgatcaaaggggatacaccaaaagggcctcacatttgatgcccttctgttgactgatagggaaagcaatattatctgtaccaggcagttttgggccagtttgaatggaataatccacccgaccatgaagagcaatcatgaactcctttatttttatgattgagtccgtcacaacgtcccatggaatactcataacacccatattcggcaagatgccaataacagtcactgcctgcaaagtcagcaagtcctttagcacttgagtgactccagtatcgatggtcagattttggaccgttaaatctattgcaatgcacgtgggttccagtagaaacatggtcaccaacattttggcctggatatgcacctaataatgttccattaggagtatttgaatctccatttgcttcatccatgttctgtatgacatctgaatagtctagtactcttacattcggagagcttgatgcaacgctggtgcttgaactgagatctttatttgaactcagcaaatcaggtgttccttgctcagaatcattttgtggcatggtcatttcaacacgaagttgattattgagtaatctgactgaaatgttgggatactctagtggcaaactttgtatattgcttaaggtatcgttgtccaaatccgaaacagaatatgtagctacaagtataatttgtggggatgaatcgtcttccgaagatgatggtgtagctcctaaggctggagcggatccaacgagtagagttacaagtgttgcaagtgctaagaaaaagcattttaccttgttgatatatttctcctttgttaagatgtatttgacctaaaattctaattttaagaccttatcaccataaaacaacttagattctttgtaaaaaaaggaaaattatgaaacgacgacaagtagcgattttaattgcaatagtatatgtcgcaataggacttatacttgtaaaacattcatttgtttccagcctctttttgtaatttcggcttcacttggtatattggtagtagacaattcttcaaaggagctacagatatggatcgcaaaatcaaatctcccagtaccccagacatgggcgattacctcaaggtatttgcctgcgcggccgtcatgctgcaaatcattctaggtcaagccctgcaaactcatccgactgtcaatatccagatcggcattggcatttgttacaacctcatcaaattcacggcaccagcgttcattaccggaatcctgtatacgaccatgcgagtcactcacgacaccgatttaagctacccgggctatctccagcaaatgtggcatgcgtcattcatccccaccattgcttggaccctgatctacttattaatcatgccaaatgtccagcaagtcgagcattatcacacgattggcgactttgcctggcaattcatcaacgggaatgctgcaccccacctttggtacaattcgatgatgttgcaattcatcattctgatgccgcctttctggtggctggccagctggtgtggccataatcaacagcgtggccggctggttctgctgctgacttcggtggtccagttggtctggttaatcttctatgacacccaagtctttcacggcccgcacgccaaggattggtacctgctggacagactatttgtcagtttcttattatatgcagttgtcgggactctggcttggcagtatcgccaagtggcccatcgctggctccaaaaacacgggttgataaccgtttttgctctgggatcgttcgtttggattaactgtgaattatttgccttcaagttccccgttcaactgactaacgccccatactacaaaccatcgatgaccatttatgacctcagcatcattagtttgattgctgctttaggcgactcccagcttagacggaaactccaggtcactcatctgattcaccgcttggccaactttgcctatccagcctttttgtccaacgtcttttggaatcaactgctttggcgaacatttggccaagggttgatgagtcgccaaccagttttaggcattttctccgtctacattggaacttggctactgtcatttgcctcagcgattacgattcaccaaagctggtcgtggcttaacagacattttcgacgacggttaatgtagtcgcggttcattttgccttgctcttggaacccgggtcgagtggagaatgtatcggttaatcaaatcaacaatctgcttgttttccggtaaatcagagtgctgggcgttggaaccagacactgtgatcgttgtaaaatgacgaacggcgccttgaaagacataccggccggcagcaacacttaccagcggcactaatccatcagacgtgtagttcttagtgccggcaactgagtagacgctcaaattattgggcagcttgttgcgattcttgatgaaatccgataacatttgcgtcttgttatcaattgaccgctcattgaaattaaacggcgacccaatcgtcatcaacttagtcatccaaacgtcattagaatattgatcaaaataattttccaaaaatacggtgtaaattaagccaccattagaatgtcctatcgctttaaaattattaaaattcaatcgactgaccaaggtatggaaaatgacgttaaattggcgggcctgttgcttgatgttactataaccgtccttgttattttgaaagccaaccacaatgaatggctcgttgtcccccggtctcagccggccggtgaagtggagtttgtcatcgttggtaattttgaccttcaataaactatgcggattcgtgcggttgtggttgatctcactgactaaaccatcaaaacggttttcggtggccgaactccccggaatcatgatgactggcgataactgagagttatggtgccgggttaactcactgacattttggtgtgaccactagagtgaagcgacaatcaagccaactgacagcaacaccgcaagaagactccataaccagattttaactgtccgtttcatcattgctcaccccggtttcgatcaagccgatcatacagtttgacaaatggcatatagatcagcacatccacgaaaatcagaaccgctccgagaatgagcgccaaccaattgccattggtgcccaagaaaccaatcaaaggccccggcgtccctgaaggtaccggataaacggctgccggaatccatttgagcgccagaaaagaagcagcaaccagcatgttaaccagtggtgccagcagaaacggaatcagaaaaatcgggttgtaaacgattgggatccccaacatcatcgcataattattattaaacagcgccggaaaaattgaccacttcgagacagtcaaaaaacgctgtcgtttggagaagactaaaattgcaataatcatcgccagtaccgcgccattgccgccaaaattggcaaagctgtgaaagagggtcacatcggtatatttgaatggcacattgaaggctgaccctgttttgagagcgtgattcaaattggtcaacgctgctggatcggtaaaggtcggacttgcagaaaacggtccgccaaccgccatccaagacagcagatccgtcaacaatcccatgccgatgacataggaaagcgcgctggcctgaaccgcatgcaaggcagttgacgagatgaacgattgaacctccggacttctggtgaggctgacaacaacattgaccacaattgaaaacacaaccaccagcagcaagggccaaatgatttggtaggatcgtaacgcccggcgtttctcaaaggcaacaatgatccgcccaacgatatagccaattatcaaggcaattaacagtccctgccccatcaaagtgctgttaaacagcaatcgcccgtggctatggggctgataggcagccatcaagaacgccagcaggccgatagcacctgacaacgccgatgtttggcgcccgtatgcttttaccgtacagtaggcaatcccgtaagcgccgtataaggcaatcatgtcaaccgtacagtggacaatcagccccaatagctgtgaaatctgcctcgcagcgggcagccacttggtcaccccgaatacggtggcaacaaacccactgggcgtcaaaaaagaatatttcaagacctcggcaaaacttcccagtaacataattggaaacagcagcgccaaagtatcctgaatcacacgggcaaacttgctctgataagctttcattgaacgggccattaattgatccatgccaatcccccctggaatcgttcatttaatcactcttattctgttttatctgccaattttgtcaagtaaaatgtcactttaatgtcatggccttgagtgatcacggaccgcaaagcaaaaagagacccaagcggtacctgaattccgcttggatctctctgttaatatttacatacaaccaactatcattttatcgatcgtggtgatcggcggctgagtgcgttcgccgcatattgacgtgcgggatgccgacttcttcaaatggctccccatactcctcaaatcccagtgtttgataaaagccgatcgccgttttctgggcccccaaataaaacattggggcatcttcaaacattggttggcccagcaggtattccaggagctgctgggcataaccgtgatgccgggcggctttttcagttgccactcgttgaatatgaacgccctttttggtgacggtcgttctagcagttaccaccggttccccattcacatagccaacaaaatgaatggcgtcggaatcagtaccgtcaaattcgtcggtttcagcaattccctgctcctcaacgaagacatgatggcgaatggttcttgcgtcttgataaatttgatccaattgatcagttaatttaatctccaaattcatacccgcctaacttgttattattgttggttaaaggccaccacatggatgtcatcgccgtcaacggtcaatttggtcaaactgccgttggctggccgctcagtcacatcaaattgaccattgccatagcgttccacaacgcttagcaatgtgttaccatgactgattaataagacgttgtcgccgtctttgatttctgggttctgtttaatcaggtcaaacccctgatccaaacgtttccagtattcctgattgttttcagcttgatggaacggatcggcttcttttagataatctttcgctttgccaatggaatatttctcaacaatatcccggaaggtcggcaatccgtgtggggcgccagccaaataccaagcttggctcatatcatttccttcaaagtagccgtaaaactcctcacggaaaaacattgacgtaattggcgcatcaatatccgaggcgtcattttcatctaaaattttttgagcagtttgctccgccctggtggtatcactgcaatatgcagccgcaaacttggtgtccttcaatttctcaccggtatcgaccgcgttttgaatgcccttttccgtcagtggcgaattgctccacccctgaagtttgttataaatgttaaagtaggtttgaccgtgacgaaccatgtacaaattaaatttactcatgatgacacatcctttacccttaatatctaaagtataacaattttttgagaatccgcgcacaccaatcaacttaagatttctgcaaaatctcttgacaatggttatttctgcgcgtttttttgataagataaagcaagtaattattgtaaggagcacactgttttgaaatatattaattgggtcctggaaaaatgcagcactcgcaagggcttcatcattttattaattgtttgcttttgggccaaaaccatgttggcctattttgtcgacctcgggctgggaattaccaatccctttcagttcctgattgtcttaattaacccgttggcaacgacgactttgttactcagtatcgccctttatttcaaaaaaagccggttcttttatccgctggcgatcttaatttcaattttaaacaccgttttgctgtaccttaacgtgatttacttccgtgagttcaccgattttatgaccgtcagcacaatgaccggctactccaaggtcaaccaagggctcagcggcagttcacttgccctgaccaatttccacgatatcttttactggattgatctggtggtcatcattttgctgttggttcttcgcaaaatcaaaatcgacccccggccgctgaatcgccgaattggtctggcagtgacctcgttttcggtcctttttttcgttgttaacctgtcactggccgaaatggatcggccgcagctgctgacgcggacctttgaccgggcttacatagtgaagtacctcggcctggatgcctttacagtctacgatggcttaaaatcccagcacaacaatgatttacgggccaccgctaccaaatcggaattaaacgacgtcttgaagttcacccgcaagcattatgccaaaccgaataaaaagttctatgggattgccaagggtaaaaacgtcatcgtgattcacttggaaagtttccaacaattcctgattggcaagaaaatcaacggccaagaagtgaccccatttttaaacaaactctataagagtaaatcctcttacgctttcaagaatttcttccaccaggttggccaagggaaaacttctgacgccgaaaacatgctggagaccagcacttacggtttgccgcagggatctctgttcgcccaacttggcagcgacaacaccttccaagccgctccagccatcttaaatcagcgccgtggctacacttctgcagtcttccatggaaacattgccagtttctggaaccgcaacaacgtttacaagaacatgggttatcaatacttctttgatgccagttactacaacaccaccggtgaccgctcgttgggctatggtttaaaggataaattgttattcagggattcggtcaaatacctccagaatctccaacagccgttctacgttaaatacattacggtcaccaaccatttcccatacgatttggataaagaagataccaatttcaagaccaccaataccggcgatgacgtggtggacaactacttcttgaccgcccactatctggaccaagccgtccatgagttctacaactacctgcgcaaaaccggcctgctcaaacactcgttgattctgctttatggtgaccactacggcatttccaattcggaaaacaccaatttggccaaggcattaggcaagaatcctgacgactgggacgattttgataacgcccagctgcagcgggtcccgttaattattgatgtacccggccaaaagaacgggtttgtttctaaaaaatatgccggagaaattgacgtcctgccgactttgatgcatctcctaggcatcagcagcaagcgctacgtccaatttgggaccgacattttatccaagcagcacgatcaagtcgttgcctttcgaaatcaggactgggtcagcccggcgttcacttcactgagtggcggcatttactccaataagaccggccaactgttgaaattaaccaaacgccaacaggctcaagtcaagaaggataaggagcgggttcaaactgagctttcactgtcagattcgttgaacgaaaagaatctgttgcgcttctatcatccaaagggctttaaggcaattgacccacggaattacaattacgccgacctttatcaaaaagaaaagcggattgagaaacgtttgggtaagaagtccaccagtatctattccaagaacggtgacaagtcgacttggaaagaatacttcaccgacgcgccggaaattcaccataagacaaccgacagcaaccgaatcaagattaccaatccagatgcgaataacaacgacagcagtcgctaagggggaaatctgagatgaaacaagccaccaagaacatgccaatcttgctttacaatatccttgtcgtttcattggcactggtttcctttgtcttggcagttcttgccctcgtgactaaaattaccctcaatgaagggccataccgagtgatctttggactcatatggctctttttcctgatcgattatttaattcgtttcaaacgggccaagtcaaaaaaagatttcctaatctccaatctatttgacttgattgcgctgatcccctcgcacccaatctttatcttcttccggattgccaggatttattcgattgtccgttattacaacctgctgtggcgatttggtctctctggcaaattaaccaacgcccttcacaaatttctctatgacaccggctttatctacctgttatcaatcagtctggtaatcctcatcttcagctcgctgatctttgcgtcttttgagcatgattccctgcagaattcactctggtgggccatttcgaccgcgaccaccgttggttacggtgacattacccccaagaccgacggcggcaaaatcatttcggccgtcctgatgctgggtggaatcggttttattggtttactaacttccaccatcaccgactttttcacttctcaggataaacacaatgacgaaaccgatgtgctgaaagatttaaccaaacaagtcacccggctgtccagacaggtcaatcagctgcaaaaagaacttaagaaagaagccgttcccaaaaagctcccaactgctaaaaatcatcaaaaaaataggaggtcctaaatttatatgttcgaacatggtgcaattgaagttcacgatgcttatcaaaacaacttaaagcacgttgacctaaagattcccaagtacgccattacagtcttcgctggtctgtctggatcagggaaatcctcgttggtgtttgacacaattgccgcagcctcaaggcgggaattgaacgaaacttttcccagttttacccagcagtatctgccaaaatacgggcagccgcacgttaaaaatatcgagcacctgccggttgccattgtgattgaacaaaaacgcatcggtaaaaatgcccgctcgactctttcaacctacacggggatttactcgttgttgagattactgttttcaagggctggtcaaccctttgtcggctattcagacactttttcatttaacctgccccaaggaatgtgccaaaaatgtcagggattgggctacgtcgatgatattgatgccaacgcgttaattgacccggaaaagtcactgaaccaaggggcaatcacttttgtcagctttggtcccaacacttggcgctggcggcggtacacggacagcggcctatttgacaatgataagcctttgaaagactacactaaaaaagaaatggatactttgttatatgcacctcaacaaacgctgaaggatgcgccggccgcatggcaccgaactgccctttacgaaggcttgattcccagaattcgtcgatcaattatcggcaaaaaggaagctcagcatcacaaggaagccttggctaaaattgtcaccagaaggccttgtcctgaatgtcatgggactcgccttcgtcctgaggtgctcacttgcaaaatcaacggcaaaaatattgccgacgttttgtcaatggacctggttcatgccttaaagtttctgcacgaaatcaaggtgccattggttacggacgtcattcgtgaagtcgcaaccaaaattcagtcgttgatcgatattggcttgggctacctgactttggaccgcagcaccgaaacgctttccggtggcgagacgcaacggattaaaatcgccaaatttttgaccagttcactggtggatatggtctacattttggatgagcccagcgtcggcttgcatccccatgatattcagctgattaagaatgctttgatcaatttgaagaacaaaggcaacacaatcatggtcgttgagcacaaccccgagctgatgccaattgcggattatgtggtggaaattggccccaaagctggccgtggtggcggtcaggtgacctttaccggtacttatgaccaactgctcaatgggcacacgatgaccggtgaatacctgaaacaaccgctgacatatcggaagccaagaccatttaaatcagccatttcacttaaggatgtcaccacccataatctcaaagacgtcagcgtcaacatcccgctgggggttgaaacggtcatttcgggagttgccggttcaggaaaaagttcgttagtggatgccttacggccaaagctccacgaaccgtatatcgacttggcgcagggagcaattggaacgaatatccgctcgacgcctgtcacctacctcgatattttggatgatattcgaaaaatttttgccaaagtttccggggcttccaccagtctgttcagttataacggcaaaggtgcctgcccccgctgtaaaggaaaaggcgttacgatcaccaatatggcattcatggacccagtcgtccaaaaatgtgagatgtgtgacggcaaacgttacaataacgaggctctcagctacctgtatcaaggcaagaacatcagtgaagtcctcaatatgccaattgaatcggcgattgacttcttcaaagatatgaccaaaatttatgacaaactaatcaacatgcaaaaagtcggcttggactacctcaccctcggccagccgctcacaacattgtccggtggtgaactgcagcgattaaagctggcagttcaattgaaccaaaccggaaccatttacttactggatgaaccaactgccggcctgcacatgaaagatgtcgccaagctcatcaaactgtttgatgagctggtggcagccggcaacaccctgatcatcgtcgagcacaacctggaagtcatcagtaaggctgattggctgattgacgtcggtccggatgccgggatttatggtggtcggattttgttctccgggttgccaaaagattcccaacaagaatcacaatctcggactggtcaggctttgaaacaatataatttagatagaaaataagacacaaaaagacggttatccgcaaaattgaggataaccgtctttttgtgtcttattttctaatggatgtactgtgaatcggacctctgcgatccggatacaagcttttcataatcgaattaacggcaatgggcgcttcgccaaaagctgtggcgatcagtggctgtttgccttcgtacttggaaacatccccaatcgcaaaaacgttctgtaaattggttttgccactgggttgaacttcaatggtgccccggttgatttccggatgagcctcccatttgttcaaggcatcatcttgagcaataaagccgtaattgacgacaatcttgtcaacggccagcttcttgatctcttcggtcttcattttctttgcttcgacttccacttgaccattatctaattgagttaagcctttaatcagataaggggtcaccggttcaatggtcgactggatcaatcgttcaacgttatgctccaaggcacggaacttatcacggcgatgcagcaggtacacttttttggccacgccgtgcaggagcagtgcctcatcaatggcagagtcaccaccgccggcaactaagacggtttggtcgcggaactgatccagatgtttgacactataaaataggctcttgccttcaaaatcttcactgttatcaactgccagcttacggggattaaaggccccgaccccggtggcaataataattgatttcgtcttggtgacttcttgattagtggtgacctgatagccgccgtcaatctgttggacatcgatcaccgtctgatttaatttaacggccgtatcagagccgctgagctgtttttccaactcatcgactaatgttctggctttgatgtttggatagccgccaacgtctaatatcgtcttttcagggtacaatgccgtcacctgaccacccatttctgccaagctttcgataatttgggtcttggcattccgcaaaccggcgtaaaaaccggcaaacatccccgccggaccgccgccaataatggtaatgtcataaaatgaatcaacttctgtcatcaggatcctcctagcgtttattaacgaacttcttctgtttacttcgatgaatgataatctgttgcccctgcagtgtcttgacttctcttaacccggcatcgatcatgacaaagattaggaaccagccgatcgcaatatcaattaattcctgcagtaatgatacgccaattccggtgttggggatatcccaatcccaaaatgtgtgcaggcagatgaccacgagaaagaatataaaaaatttgggtttcgtaaagaagtcccgcacggtaaattgctttttccgcgtcttgccgagaatcacggccccaccgataatcgctgcccaaatcgcatgggtgccgatggcttgaaaactccgggtaaaaattgtggccagaccgtattcactgacataaccggaactttcgaaaaccgagaacccggcaccaatggccgcgccgattaggacgccattgaaaatgtagttggctttataggtattaatgaacaaaataatcacgacacatttggccagttcttcaacaatcccaacaatcaaagcagattcaatactaacctcggttcgaatcggcaggatgagataaaaggtcatcgtcacaattaacgacagaatcccgccgactaaaaagatcaccatggtttgtcgcacagaaatgttttgatagacgttgatctcaaagaacatcatcaaaagggagaatggcactgccaaagacccgataaaaataattccgggaatgaccttgttacttttgaagacaaacagtaaggccattagcatgacgaagctgactgccagaactaaaaagacgcgggtaaaaaaccacggcgtgaccggccggctggatactttccgcaggctgggagtcgttgttttagtgccgacgatgaataaacggtcggcttcgtctctggaatgccgtttaaagacttccgaaaacatccgtgataaatgaatctcaaccggactgttgggctcggactctcccagatgtttggcgatgttatcatccaaattatcataatttcgacgaacaccggtccacaccaaagagaaaaaatgactaccaattgttttaacactttttttcataatttactcctaaggttgataccattaagcgtaacttacaaattaatcggtttcaagttcgaagcggaattgagtttccaataaaattcggttatgattaggtaaagggttttcatccttgataatacacaaacggaggtagttcttaatggctcagaaaaaaatgattctcgacctggacaccggtattgatgacgcaatggcaattgcctatgcggtcgccgatcccgatgttgatttaattggtattatcggttcctacggtaatgtgtacgttgaagacggggttcaaaattcactgaagattttggaactcttgggcgcaacggacgttccggtttatcaaggactgtcacactcatccgaatccgatcacttcgacagaatgccggttagtgcccagattcatggtgaaaacggcatcggcgatgttcaattgcccgaccccaaacgtcaaccggaaaaaggcgatgccattgacttctttattgacgccgttaagcaatacggtaaggatctcatcttggttccaactggtccattgaccaaccttgacgctgccattaagaaggctccggaaattaccaaggaaatcggcaatattaccatcatgggtggcgctgttacggttcctggaaatgtaaccaacgtcgccgaggctaacattcaacaggatgcaaccgccgctgatcacgtctttagaaaggccccactgactcaagttggcttggacgtgaccctcagaaccctattaacttacaaagaaacccagcaatggcgtgatcttcacaccaaatcaggtgaagccttcgccgacatcgttgattactacatcaaggcttatgaagtcaccagcccagaccttcacggctgtgcccttcacgatccgtttgcggttggcgtggcaattaacccaggtttcgttcaaaccatcgatttgaacatgtatgtcaccaccgatgagaagtattacggccgaacgaccggagacccggcaagactggatgatccaaacaccaacgttaaagtggctgtcaacgcagatgttccagcctacctgaatgcattcatgacacacttgactggactgttcagtaaacattaattcgaaatagaagttgccttataagttacacaaacaaaccgcctattccccagacaggaataagcggtttgtttgtgtctatgaatctaatcgatgatgcgtttaacttcgtcttaccagtaacccaagagtttagtcagcttggcacgatcaatgtctcgctgactcaatgtcgcggttaaagcgccgccttggacgttgtcggaatctttgtaagtcgtccaatcatacttggcattttcttggctctggccatcttcggtgctggccggagctgccatgatgtcttggaagtatggggtatgatccagaccgagagcatggcccaattcatgggtaatcacgccgacccagtaattttccagcagttcagttggcgtaccgctgacggtggtggtcaaataatgagcgctagtatcacgatgagtggcagctgactgtttgacacgggttgctgccatcccctcagcggccccgtcaacatctgtatcatcagtcgacaatttaatctggatggtttgcgatgagggcaatggcatcggaccatatggataagtccgatcgtggaagtcgtaataatcgacctggacactgtcgccgtcaaagacaccatcccagccttctgattggccgttaccaaatcccaatgtcaagctgtggttttgtgccgtcccaagcgtaaagacagtggtgcctaaagcagtgttccatttatcgattgccttttgcacgtaaggctgcagggttggtgatttgacataaattgaggcctgatcatctgtaaagacaccctcatcggcatagtttccaacattgaaattcttattgaaaaccgattgataggtcttataatcagctgaggtcagactcagtaactctccagtcggatccaagtccggagaagccgcaattaaggacgacaatgacgatttggaaatgacttggggagtggaaatcgagttatctgattgagaattcgatgaactggtcgatgtcgtcttggttggctgatacagttttaagtatttcgagtagacatagcctttgattttgccgctcttattggcaacgtaagtgtagtatgccgtcttgttgttggtggtcttaatggtgacccgctttttagaataaaaagtcgtcttcggataattttttaagttatgaattttcttggtgagcttgggtgaattatacatgtaacccttggttgcccgataagctttggtcgcaaccttctgaactttgaccactttgacggtctgcttggcactcacgtcagctgtcgaagtaaaaccgccgagcagcccgattgaaaggaccgcagcaaaaattaatgtcatgatgccttgtctttgtttcataacgattcccccgttcatgattgttgatttgaattacatttatcataatacaaatgaaaaatcgaaaaaagactgtcagatcaatcttaaacattttaccgggagctggggttcgggttatttaaaatagtgattaacgtactgagccaccccgtcagcatcgttgttgccggtaatgacatcccccgcttgtttgactgggtcttggccgttttccatgaccacgccgatctcggcatttttgatcattcccagatcattttcagcatcaccaaaggccattaaattgctgaagtccatgtcaaagtgggccaacaatgccttcaagccgacaactttatccataccggcggccaaaaattccatgatctgcggttgtgaccggacaatgtgatattggctgcgtaaggtgtcatcaatggcgctctgatactgatccagtaactcaggcttgtcactgacaatggctttggagtattcatcagtcgtgctcaaatcagaaaaggcccggggaacaaagtcaatatttcccttgaactgctgctggtacatcgacggctttaaatcggtcattggatagacctgctggaagtccaagatgtctaatggtgcattctcggctttgacaaaattgtgcagcggcaccaaatcggccttctcaatcccactttttgccaactcggccttatcattgttatgaaccactagtgcaccgttgaaagttattgtataatcggtgtcttcagttaatcctaactgttcaatgaaccgccaaatggcattaatcggccggccggtgcagagcaccaccttcacgccggcgtcatgaatggcttttaaagcctgctcattgcctttggaaattgttttgtcactggttaacaaggtaccatctaaatcaagtgcgaccattttaatcaacttgtccgtctcctttatttatctgatttgattttaagcaacaatcacgtgaaacacaacactaggaattttccgtcgtccttacattatgtgagaatcataaacagttccttaattgcttttaatgttgttccgtacaaattaaaattgccccaaagttatcgataattttatccgcgtgggagagtaatgatttgggccgatttcacaaactaaaaaaggaacttgagtaagatattacccaagttcctcaattgatccgtataactgattagttatttttatgaattaactaatttgtgattccagttcacgaagttctgcttcacgaacacttcgtggcaagaatcttctgatttcttcttcgttaaatccaacctcaagacgatgatcgtcaaatataatcggacgtttaatcaaatcggggtacttaacgacaagatcaaccaactgtgaaacagttaagttgtccaggtccaaattcaacttcttgtagatgttagaccgtgtagaaataatgtcttcactgccgttttcggttaaacgtaaaatttgttttacctcatcagcgttaagagggttggaattgatatttctttccttaaaatcaatgtgatggctcttcaaccatgcacgtgccttccgacttgaagcgctgctttgtgctacatataaattcagcattacaattcccccctgctcagtaacaaaaaatacaaacgagaaacaacatccttcgattactatattatcatactgacaatatttgtcaatacggttacttacttatagtaacttacttgtgaaattaattatacaccatttatctgctcaatcaactataatattggtattaaaatcatttaaaggagaaaaaaatgctagtcttctattcactcaccctgttaatcgtggctgcgatcattgctaacatcttgtacacaatctttcccagcctcccgttaaccttctatcaaattggttgcggcttcttattatcattactgccattcttccagaattattctttggagccggaaattttcatgctgatggtgattgcgccgttgatgttcaatgacggccaaaacaccagcgcgagctattttcgacattcaatcagacaaattctgaatctggcagtcatcctggcggtggtgaccgccgtcatcatcggcttagtcgcccacttgctgctgccgctgatcccgctggcactttgctttgcagtggccgcaatcgttactccaacggactctgtggccttcaaatcaatcactaaagatattgaactgccgacaagcgtttccggtgcactggaaaatgaatccttattcaacgatgcttccggaatcgttatcttcaatttagccctggcatcctttatctccggggatttctcatttgctcaggggctgacgcggtttttgatcagcttcttcggcggcctggtggttggcgcagtcgccggtttgatcttcgtaaaaattcaaacgctattggtcaataaatcaatggatactgccagtgtgatcgtgccatttagtatcatgaccccgattgccatttacttattttccgaggaactgggatgttccgggattttggcagtcgtggctgccggcatcatctacggcatcaatcaaagccgtttaaagctcacttcgaccagtgtgcggctggtcaccaatgcgacctggggtgtgatcaccagcctcttaaatggggtggtgttcgtcctcttaggcgttaccctgccgaaagtcatcaaacgaatgattccctattcaaataccttaattatcaaattggtctttgatgcactggcaatttatctggttatgttactcattcggtatatttggatgcggaccaacctgtttggcgtccaagataaagtcccaacgacgcgcgaagccctggtcagcgctgtcggtggggttcatggaacgattactttggccatggcactgtcaattccgctgacgtcccttggccagccgtttccattccgcgaccagttgatctacattgccacaattgtcatcttattaagcctgattgtcccaacaatcaccctgcccctgttatgtccgaaaaagcaagttgaggatcagggtcagttcaatcaataccgtggtgaaatggtcaactacgctatttcccaggtcaaacaagactcgacgatcgcacttttggaccgcaactatgtcattgacatgttgaacagccagaaaaataatccggaagtcgaccgcaaacaggtccaggaaattatggccggcgcccagcaagtcagcgtccaagcggtggtcgatttagccgccgagggcaaaatcgaccaaaagattgccaatttgttttcacgacggatgatcacagcgcccagcaaccacttgggcttttggacaaggattaagtatatttttaaataccagctgcgccgatttaaatcgcggaagaaaaccaaacaaatcaaacaacgaatccaagcagccattcccaagcaaacccgccagcagattcatgaccagcgccaacagactaatctattgatcaaagacgccatgtttaccagtgccaacagctatttagaccaaattgaagacgatcaaaacagcaatgcagttaattttgtccgcagctcatacagcttccgccagagccgttctgcaggtgacacccaaactgacagtgacagaaatagcttgttaattaaatcattccaatatgaatacgcctacgtggcagatgccttcaaagccggtaagatttccaaaagcctgtcagaccagctcagccaaagtatttccactgatcagatggcttacatggagcagggatccggaaccgatttcctgttggcttaactactttggccaaccctaatttacaatcatggcataattgactatacttgacgatatacttgattttgtgtgggtgaaaatatgaaaattacgctactagcgaccagcgacacgcacgggtttattgaacctaccaactacgttgattcaggtcttgataaacccttcggtattgagaaggcgtgttcgacgattaaaaattatcaaaagacccatcccgatgaaaagatcatcgtgttagataacggcgatttccttgagggatcaccgatggcttattacgtggccaagcgagcagataagcaggaccaagaggcattttttactgcttataaccaagtcggctaccaactcggcaccatcggcaaccatgaatttgattacggactggattatctcaactacatgatgaagaattcagaccgccattttgtgtgcgccaatatcgttgataacaataacgaaccgctgttggccgacccatacacaattatggatgtcgccggcgtcaaagtcggtttcttgggcctgaccaccacttctactaaaaaatggaagaacgtcaatgatctcaacgattttaatctcatttcggagttggacgcgtgcagacgctacgtcccggaaatgcgcaagaaggccgatgtggtcgtcgtcgtgtatcacggcggttttgaacgtgatcataccggtaactggaacgatatcaacccaggcgaaaaccgcggctacgacatcttgaagaatatcccggggatcgatgcgctcatctctggtcaccaacaccgcaaaattgccagccagttatttaacgtgccaattgttcagccaggttctcgcggacaatacgtggccaagatttcgattgagaccaagaaccacacggtcacaagaagtgaggccgaattgctgaacgttaaagacagtgaacccgaccagacaatcaaatcaacggttaccgatttatccaaacatttggaagcgtggctggacaagccgctttcaagaatcaagggcagcttaactttcgatgacccattcaaagcccgaattcacgaatcagcatttatcgaattaatccaaaaaattcaaatggataagatgggaactgacctttcggcaaccgccctttacaacaatgaggcccacggatttgaagatcccattaccatgcgcaacatcattaccaactacgtgtatccaaacaccctggtcgcctcaaagattaccggcgccgatttgcgcggcgctttggaagtgaccgctcaatacttcacggtccggcacggtgacgtcgtggtgaacgagaaatttgtttttccaaaggaacgtttttataactacgatatgtatgaagggattgattataccctgaatatttccaaaccggttggtcatcgagtcacccaattgaagtatcatggcaaggatgtccaagacgatcaagtcctgaccatcgcccttaaccgttatcgagcaagcggcggcggccactatcccatgtataccagcgataagatcgtcaaatcaagtgatatgacaatcagccacgtgattatggaatacttacagaagcatccggtgattgaagccaccgtcaatcataattttgaaattatttctgattctgagaagcgcaattaatttattcggcaagatcaaaaggctcctgttatttttaaaatgctcttataaccccaactaaatgaagaaagggtctgtaattatcaatcgatcatttaaaatccaaattagattatatctggtgttttgcggtttgatattcgtcctcatgccgctcgtccggattggcctaagtttttcatatcaactctcattttgctttcttgctatcattggcctttatctatgggcaagcgaaataatgccaccgtacaggaatgttccggcatacaaaatcccgcgtttggtcaggaatatcagtattgtcggtgttctgcttttcttggtttatgccttagcgacaaactttattaaatgaaattagaaactgttccatcgcaccctaaaagaaactggaacaataggccaattcctgccatttaacataaaagtgcaatcattcttggttttagaatgattgcacttttgtgttaaatggtaggaatcaaaaggtcccttgtccccgtctttttttaattatgctttcttcaatcgtttatgcacttttttcttctcagcgccaacataagccaccgctttaaagtcacggatcgaggtaactttgatcttacctggataagttaactcattttcaatctcatccttaacttcattagccaactgttggttctgttgatcgtccagtttctttggatcaaccacaatccggatttcccggcccgcttggatggcataactttctttgacaccctgcttggagctggcaatgcgttccagatttttgagtcggttgacatactcttcaacagactcgcttcgagcacctgggcgcccaccggaaattgaatctccagccgcaaccagatgagcgattggcgttgttacttcaacatccccatggtgagaggcgatggaattgatgacttgtgggtcctcaccataggtttcggcaatcttaacacccaactcaacgtgagtgccgtccacttctctatcaattgccttaccaatatcatggagtaagccggcccgcttggcaatcttgacgttcaagcccaattcggcagccagcatccctgaaatatcagcgacttcaatcgagtgattcaaaacgttttgaccataactggtccgatacttcagtcgaccaacaatctttaacagatccgggtgcatccagccgatgtgaagcgaaccaaccactttttcaccggtgcgccggagctcgttcatcaaatccaattgagcgctctcaacctggtgctcaattgattgcggattaatctgcttagtgaccgccaagttggtaatcaccgtcttggcaacttctcttctcagtggatcctgggtgaccacgtgtaacaaatgcggatcatctggatcaaacaccaaatcggtacccgtcaaactttcgatgtagcgaatattagaggcctcgcgaccaattaacttctgcttagtattgttgtcgttaatttgcactgaatgctcaatgtgttcacgcggcatgtcgacgggtccgcgttggatggcgtcgtcagccaaaattttggccatctttggcgcgttgacctgtgcttcgtcatcttgatatttcaattcaatatctttttcacgcttcaacgccgtcttcaattcatcgagaatttgttgtttagcctcggctaaactgattgaaccgcgctcctgcaacgtttttaatcgttcctgggacaaatcatttgcggtgtggtgaagctgttcaatttcagctttttgctgattaatttcatggctttcgtcagccagctttgaatgcagctgatccagacgagattcggtttgcttcaaaccggtttcccgttgttggattctggtctgtcgggtgacgttatcggcttggtagctgtcaagttcttcttcaattgaatcctggtagtcaatggtttgttgcttgccatcggcaataatcttggcagattgtttcttggcgtcttcattggcgttgttcaacagcttttcagcagtggctttcgcattttgaatctcctgctggaagtgacgcttttgcagctgcatgccgcatgcaacacccacgatggccgccaaaattcctagaattatgattagtaacaagtgcggacctcctttctaaaaacagtcctaatagtagtttaacatactcactgattgaagtcgccaaagtttatagttagttcaaatagcgattcaaaaactttttgacggtatccgtatagagtttcgggtgggtactaaatgaacgtgaatgagcggctcccggaacgatcagcagctgctttggccccttgtcagcccgatacagtgggtaaaccattttggtcgggacaaattggtctttggcaccatgaataaacaacatcagccgtttgttcttcgcaacttgattcaaagcgctggcttttttgaacgaataaccatttttcatgtgattaatcccgctcacaatgtcgaccaacgggaatttgggtagatgatacatttccttggcctggtaggcaatctcggaatagacatccgtgtagccacagtcttcaataaacgctttaacttgagtgggcaggcctttgactccactgaccatcatcgtcgtcgcaccacccatgctggttccaaaaatcgcaatttcagacttttgaccggtgtggtggatgacctttttgacccatttaacgtagtccaagcgatccggccagccatagccgatatagtttccttgactgtcgccgtgaccgcgggcgtccggtaataagacgttgtagcccaggttgtggaacaggtaggcatagtcgaacatgcggttcttgttggacatgaagccatgagcaataatgatggtcttcttggtggccttgtcagctgatatgtaattggcatctaatttaaggtgccgagtagcagacatttcaaaccaatgctgcttgtcagcaccctgataccatttgtaggccggatagcgcgagttgccgggcttgattggctcagtcttgcttaaaaatgatttgggagccggtaccacggcaacattgtaaaaatacatcccggcaccaaatagaccaccacagatgatcacaactgcagaagccaatccaataaaaacttttgtttttcgtttcattcatccatcccaccaattcaatttttctcgtgataaatataccacattctgaattttaacgccgaaatttggtgattagcaaaaaagtcgtataatataagtaacgaacaggacggtgatcacatgtttccagaaagattacgagcattaagaaaaggccaacaattaactttggaagaactagcccgcgcgatcaacaaagattccccgactgataaggagcatgaaagtaccggctctcaaatcggtaactgggaacgtggcatcagaacgcccaactacatcgaaatccagcgcctcgccaagttcttcgacgtcaccatggattatttgacagggttatctgaaaataatacctatgacttggcgcgactatttatttcagataaaaccttgcaatttaatggtcaagatttgagttccaaggaccgatatgaaatctatcagttaatctcaggttacgtccacggaagaagcaatgccccgcacgatcaaggaccgcggacggaacaaggagaattagatctttaatgtctcaagcaagctgtttaacttctgagcatttattcaataacgaggtttgatgcgttttcgcgcatcgagcctcgttattggataatgcggtcgaagttggcttggtgagcgtatttacgtaccgtcacattcagtgctaaccaaaaaagaaactcaaacgcttatctcaaaaggagtccagtatgctaaccaataaacaaaagaaaaagttgctcaagaaaaagcaccccactacccaaccggctgaatccaactatatcgcccagatgctaaaataccgcgatcaatttgctgcctatccacaggttaaatttctcatcaataatgtcattgaaagtgaccatttaatcaaacaaggactcctaccgcaagacttgccggaattaattctccccgatgatatccaagatcaaattttcaaagatatcaacggtcgattcaaacccggtgatcccaaaggcgaccagctttggaacgagctgtcggatgcgctgcccaaacttgataaacaattgcgttcattccgggattacttagagagtcaatacgggatgtgggcctatatctctgccccgtttatcaaggatctcgccgactccattggtgactcaccggtgctggaagtgatggccggcaacggatatatttccaaaggactgaatgatcttggcgtaaaagtcttcccaaccgacagtcttgaatgggttgacgaaaatcaaacgggtaagcatcagctgattcccgttgaaaaactggatgcgctggctgcaatcgccaaatatcagagccaggtgaaatacgttatcatgagctggtcaccggacaaacaaacgattgatgtcgacgtcctcaatgccattagaaaagccgacaacgatttggaattaatcgttgtcggcgaaaaaaatggtgctaccgactccaaagctttctggcaacaagcccatttcatcaagcccgagactgccaaacagctgaaccgacatcaccaaccatttgatttaattaaagatcagatttacctagttgactaagcttaggcaacggtaacttgctaatcaaagcatgcttttcaatcggcttcttctccaactcgagaagggcttttttagtttctttaccgccacggtactcgccgatgtcgccgctgctgcgtaccacccgatgacacggaatcacgatcaaatccggattcatagccacggcgtgagccaccggccggattgccttgggtttaccaatattttcagccaactgcttgtatgtgactgtctgcccatatgggatcttttgaatttctgcccagacctggtgctgcaaatcggtgccgatattctccaaatccagcggcaaatcaaagtcttgacgcttttgatcaaagtaatcggtaaattcagataaataatcagcggtcaccgaatcgtcgtacataaattggtcatcataacgatcggggtaaaaatcaaaaagttcagacaagtacttaccggggctggaaacaaagttcaaccctttttcagtgactgtgaagaagaatttttgattattcacttcgatgctttcccaatacaattttttcataaatgtaattctccattacctacaaatcgtctatttccattattgtaacatatcaagccggcggatgagttggcttcgcttgactcacggaccgggaattgccacaatgatattatagattgtcaaaataaaggagccgacttaaatggcagacaccagcaagacttttacccgaacaaccacgggcttgcactacgacttaagtaaaattaatattaataaatcgattcacgaactgattgatgacggaaaaaagattcgtgaccggatctcatttgaccagctgggaaaatttgtcccggttaagcgtaacgtggttgaaggaatttctcacgttgaagaaaagatgatcggagatttaatgccgctgcgccacaagcgtctggcagcctcggccttcgcatttttccgcggcacggatgaattgatggctttcgacctgtcgaaacagacctccaccaatattccggtggtcatttccggtgacgctcatttggggaactttggtttttatgcgtctcctgagcgaaaacttctgttcgacctcaacgacttcgatgaatccaccattggctcatgggactgggacctccggcgcctgcttgtcagcattgtcctccaaggagagcagctgggactagccagcgaccaaattaacgagattatgcagggagcggttgaaacctaccagcagattctcagccaatgttttgatgaccactcggcaatggaacgctactacttctccacagaagttgaatccttcctgcagtcggaggactccgatcacaaactaccaaaagtttggcgcaaaattcgagatagtgccgaacaacggaactctgataaagtggtcaaaaaattcacgacattggattcccggggacatcttgtctttaaagaaaacgctccacgaaccgtccatgtcagtgatcgccgcttcaacgaaattcgcgagcacttgcggagttacacccgctcggtcagcccggacgtcaccgtcctcctttcacaatttcatatcagtgatattgtccgccatagcgtcggtgttggtagttttggcacccggtgctacctggtcttgttaaccgcgattgacggcagccacctggttctccaaatcaaggaggccttgcagactcggcgttttagaggttttgatgtgacgaccccatttagccagagcaagccggataatggtgagcgaatcgtcacctgccagcaaattttacagcgggcgtctgatccactgctgggcttctatcacaacgatgataccggccgcagcttctatgtccgtcagttctgggacatgaaagaatcgattaacttggacaaattagacgccgatgattttgccacctacgctaaaatctgtgggctcctgctggcacggggccacgcccaaagtccgaccgccgcgattgttcacggatatgtcggcaccaagaaaaaactagtctccgctttaattaactgggcaaatgaatattcaaaacaggttcacgaggattaccaggaatttttggattcgttggacgcggatgaaacgagggaataatgatgcataaagttgtctttcacattgatgaattggataagtgggatcacacactgagcaatattagtaacctgctggattatggacgggtgaataaggaagaataccacattgtcgtcttagtcaacggcgatgccatcaaaggctatttggacgagcatctgcgaaatgccgttgagcaattcagccgagaaggggttagattccacgcctgcaataattcgatgaatagccattcgattaaggaaaatcagttaccggcaaacgttgaaatcgtcgctgccggtgtcgctgatttggtttcactgcaggaacagggttttgcctatatcaagccttaaagtgaaccaaacgatcatagtcgttatctgggagcacgcttttttaatagaaattttagtcactaacaagaggctgggacaaaactaaaaatcttttaggacagctcgacaagtcaaagaggcacagataaatatgactcacagcagaattacgatcctgcctccgtcacacttatctgtgcctctttaccgacttgtctcactcactactttttaggacagcttcataaaccagtctctgttctttaagcaaggctcacgacgggacacaatcccgcctccgctcgcttaaagaacagagactaccggtttattttgctcactactttttataattcggtgccaccttcgtcatctgcacatcatgtggatgcgattcgatcaagcccgcatttgtaatctggataaattgggcattctctgtcaaagcctcaatcgttggtgcaccaacatatcccatgcctgaacgcaaaccaccaaccatttggaaaataatattctcaaccgatcccttatattccacacgcgcttcaataccttccggaacgagtttgttagcttcattcacgccgccttggaaatagcgatccgctgagccattcgacatcgcactcaaactgcccattccgcggtagctcttgtactttttaccattatattcaatgacttcacccggtgtttcatctgtaccagataacatgcttcccagcatgacagcattcccgccagcagctaacgcttttacaatatcgccagaatatttaattccgccatcagcaataatatgcttaccataaacacgggcaaccgttgcagcatcataaatcgcagtaatttgaggaactccaacgcctgcaacaacccgagtggtacaaattgaaccaggaccaattccaactttaacaacatcaaccccagcatcgaaaagtgccttcgtgccttcaccagttgccacattgccagcaattagcgttgcatctggaaaatgttctctgatttctgcaattttacgcaaaacaccagcggaatgaccatgagccgtatcaataacaatagcgtcggcaccagcttgaagtaaagcattagcacgatcaaaagtatcgctcgtaaccccaaccgcagccgcaaccaatggccgaccagcctcatcacttgaagcatgtaaatatttcttttcatcagcttttccagctgctttaacttctaaaacttgagttgcttgatcttcaatggacatgttcttatggataacgcccattccgccttgtcgtgacatagcaattgccatcgccgactcggtaactgtgtccatccctgcgctaataatgggaacattcagcttgatattatctgctaattgcactgataagtctgtttcattaggtaaaacgtggctttctgccggtatcagcaatacatcatcgaaagttaaaccttttttcacaaattttgtatcccagttagacataattaagatctcgctcctattcgttttttattgactattttgctttcagcaaaatcctatactcactacggatgtccttcctcgctaagtgctaaagcactaagtcggacaggctcctattcgttttttattgactattttgctttcagcaaaatcctatactcactacggatgtccgccatgtttcttgcggtctgtctttcggccacaagaatggacatcgcccgaaacatccaagataattagcgtatcttgctaattatcatccctcctgtggagtagttcctcgctaagtgctaaagcactaagtcggacaggctcctattcgttttttattgactattttgctttctacataaatccgccagtcacatgataacggcgtttgaaccacatacggaccacaaacaagactgccgcaagtaccaaataggcttcaaatggcaaaattggattcaaactttgtggcaatgatgagaatagcatgtaggctaccatccataccaaaatcatccccgtcgccatcccaattgtcttccaaatcgattgacgttccttctttttggaggttggttgcaaacggtccgttaagaatggtgcacatgccccaccaataattgaaatggcaagcattgcagtgattcctgctggtcccggctctgaagtaactgacttaggctggaaaatcatcatgattccaaacattaatgcaaaaatcattaagaacaccataccattgtccaaagctttcatccaatacttagtttctacaggtgccttcttaggcccttcgatgatttctttaacccgatctgttggtgtgccatagatctgtttagccgtttcaccttttaactgaccttccagtaaacgcaacttagtgtcttgcaaagcttcttcttttttttcttcagataatttatcattttcattcagttcttttgttaaacgaaacatgaaatcttcatttcgttttgtgtaggtttgcttggcttttcgttctgaatgaacctgcttacccgcattccgttccgttgtcttatcttcactcatttgattctctcctctgtttacgattgcttacacattgaatctaaattcaataatatcgccatcttgaaccacataatccttaccttccaagcgaagttttccggcttcacgaacagcttgcatgctaccgtctttatcaagatcagcatatgaaactgtttcggcacgaataaagccccgttcaaaatcagaatgaataataccagcacattggggtgccttcatgcctcgtttaaacgtccaagcacgggtttcaggaccaccagctgtgaagaatgtttccaaccctaaaagcttgtatgaagaacgaatcaaacgatttagaccgggctcttcaattccttctgcttctaagaaatcttttttgtcgtcatcatctaattcagcaatttcttcttcagtttcagcagaaatccccaaaacttcagcttcaggatcgtctttagccacataatccttaattgttttgtagtactttgagttttcaggatcggccatatcatcctcggcaatgtttgcaacatacaaaacaggttttgaagttaataggaagaaaccacgcacaattttcatttcatcttcatcaaaatcaattgaacgaacagccttaccgctttccaaaactggcttgattttttcaagaactgctaattctgccaaagcatccttatcacggcttttagccgcccgttgcactttgcctaaacgtttattaacggcgtccaaatcagcaatgctcaactccaaattaatggtttgaatatcttcaattggatcgactttaccagaaacggttgtgatgttgtcatcatcaaatgcgcggacaacgtgcacaattgcatctacctgacgaatgttttcaagaaacttgtttcccaagccttcgcccttgctagcacctttaacaattccggcaatatccgtaaattcaaaagtagttggcacaatttttttagccggaataatttcttgaattctggctagtcttgcgtctggaacttcaaccatccctacgttaggatcgatcgttgcgaatggatagttcgccatttccgcaccggccttagtaattgcattaaacaaagttgattttccaacgttaggtaaaccaacaattcctgctgttaatgacatttttcacacgctttctttaataattttaatttaagtgtatacatgtaatatagtaacaaaaaagggcagctagggacaggggcagtattcaaaaacctagatttattggtaaatttaacgtcattccaaaaaataatattactaggtgccaaattccaattttttatgttgctgagtaaagtttttttcgcattttatctgcccagtgctaaactataggcaactcggttaaaaaaataggaattcatactttttaaaccaaattcaggcgaaattatgcaaaagattaaactattcttcgttctgaccactgttgcaattgttggtttctgcctgccaacaacaattaaagcatcagacacgacaacttcaaaaccatttcccaacaacgaaattttaggtgtgggatcgtactttaacgcgtttgctgccggaaccatgacaatcgatgcgaataacacttcaaatttagagggacgttatgccgctaatagtcttgaatccagcacagatagttggaatacgcgaaccagcaacacacagtgggggcaaatcacaagtgatgtttcaggaaccatttctggaacaccattgtttacggccaataaagttgattctagcaccacttatggcaactatatgcgtcacatgctggacccgaacacacgtcaacgagcttcaatgtcagcgcccgtcgtttcatcaaaaaattcagttgtcattaataatttgcgtgctgaagccaaagattacacagatactgacaaaactaaccacgcttcgttattagatattttaaatatggacaaaaacgttggcgacacttccgatttttctggcacgaatggttctacccttgcttctgtgagtggaaaagcgcttgatccggatgccacggatgcctctaattactttgatgcggccgccattcagtttaataaaatttctcaatattatgatcaactaacacaaccggattcagacgataacaaaaacgaagacaaagttgttgcaaacgatcaggtaaatgccgtaaaggttacgcaaaccgcccctgaataccaaaactacactaatttaacgatcgatgtcactttgccggatgactacagttctgatgataactacaaaacaccaccagtgattatggtcgggattaatgctgataacgcaactgacaagaacttaaatttaactattaaaattcataatatgaacaccgcaacaacttcagttcaagctggtgattcatcgtatgattcgtatacctatgcgccttacatttttattaactgggataatgtcacaacgcagagtcccttcagtaactggcaaggatcttttaaaatgaaagcctatgccggaacagattcagatgaagaacctgccaactctggtaacggtacccaacaaagtcagttattttcaagtcacgttttaaataatttccccaacgcgacaaccagcggcacagacacccttaaatttggcaataccgctgatgacagccaattatgtggggcaatgctgcttccaaatgcgagcgtgtcgttaaattcaggaagtcggacactatatggcagtattctatcaggaaaaaatattacaattgctcatgacatgccagcttcgcgtttaattgccggaacgtttgacgtcaataacatctccggaaatgttttctctgatttacattctgtaaatccttatattaaaaatctgaatttggtcacaactaatgctttaactgataaggccatcacagctggatcaaccggtgactcggccaacaaaaaggaaattacggtaacagatccgactaaatcagttggcttgacaggaactgtggtcactagaaataaaaactatcagttattctatcgtcttaacaatgacaaaaccgcgacatcctggaaaaaactgaacgctagtggggtgaacacaaatagtaacagtaactttaaggtaaacaacttaaccagtttatccggttatcaacagaaactatctgctgagtcaatgcaatctgggagtgccagtgatctccccactctgtcgacgattggtggcagtttgcaacgccaaaatcaaattgaaatcgtggtggcaccgaaaactgacgactcgggtcaagcaatcaccgcagattctgatttatctgcttatcagcacaccaccattaatttgacagaaaccggaaaattaactgctgatattccaaatacatttcagctgacacctagttcagacgatcccgatgtctacagttcatcaagcaactcacaaaatatcacaattcaaaatgattggcgtgttccctatacgcttagtgtgcagtacaacgacgctctggccgccaagtttcctgtaaatgggttgaatctgtttgatcaacctaaactggtaagctacactgccaatggcaatgctttcgatattaaccaaccactattgcagcagttggcggataacgcattattagcaacgtcttccaccaactttcaattaaagcttaatgtctcaaagcttttggccagtggtgctgttcaatctggaaaggagtacggaattcccctttattggacgttaaaatacgacttagcttcctagaaaaacgaaaatacctacaaataattagtgatttccattgcatttaccatttagaacccgtagaatataattagccacttaaaaatctgacggctaataagggccgagaatagggagttcacaatattatgaaaaagaatcaattaattactgtattaagtgtattaggaattagttttgcattaggattaagcaccacttcagttcacgctgatagtactggaacaagttctgtgggagaatttaccgttagcgctggtagtttgagtatcgatagtgttccagatttcaacttcggttcaactagtgtgaaggatctgactacaggaactaccttgaattatcaaagcggtagcaataataagcttactgtttctgattatcgaggcacttcaaatcccgaatggactttagaagctagtttatccgatttcactagtggtaacagtaaagttgctggatcaattaatttagctactgacacaaaggccgctggcacaattaacggtgctgctagcgaggtttggaacaatgttgatgctgcaacaaacggaaccggtgccgcatccgcaactgtaagtactgatacgaaattagtcacagaagctaattctgctgtagatggtggaacttacacttctgatatcacttggaccatgaccaacacggctgcttctgccaaataatcgttcacctatttatataattcagttgaagagtaatcacgaccgataactttcataagttaacgtcacttactcttttttatttgcaaaggagaaaatgatgtttcgaaaacttataaaaactattttggcaattgggatccttggccttatatcacttgccgcgcctcattccgttcatgctgccggtgccggatttacgatcactcccattgccagcaagcaacaaaatgattcgtcggtctcttactttgatctaaaacttaagcctaatcaaactgctcaagtcaaagttaagataaccaacacaaccaccaaaacgcttaacttgattgcatctcccaacacgggatacaccacagatatcggttcagttgcttatgacctgcaaaaattaggcagcaaaagtacggctccttatcagttacaaacactgatgggtggtcaacaaaaaatagccgtgccagccaagagtcaaagggtcgttacttttccgattaagatgccggcaacgtcgtttaaaggtgtattagatggtgcgatttactttctcaatccccaaacaagtggttcgactgtcacaaacaaaaagggttttagcatcaaaaatcgttttgcgatggctttaggcgtcaccattcatgaagataccaaaacaacggtgctgccaaaactaactttaggaactatcagtgctggaaccgatcaaaatgacacatttagcccagctgtgaaggttaaaattaataatacgcatgcgactttgaccaaaaagttaaaaattaagagtcaggtttcgcaaaatgggaagacgctgtttaagacaaataccagcaacttaaccatggcggcaaattcaaatttcaattatgcgattaccaccaaccatactgcgctcaaagctggtacttaccggctgcacctagtcgcacgtagcggttcgcaaaaatggacctttaatcgtaattttgtcatcaccaaaacacaggcaaaaaccgccaatcggcatgcccgggttaaaaagaattacttcatctggtatatcttagcaattctgttagttcttctattgttacttaccgccttttggtttggccgccgttcttcaaaacagaaaaaataaatttcaaaaaaaggatctgtaatcgttgttatcatacgattacagatccttttagctaggcttttgctttttttaaaacttttttcagtttacgttcaaaatcacggcgcgacagcatcacgatatgaccgcagttcatgcatttaatcttaatatccatgcccattcgaatgaccttccattcgtttgcctgacaagcatgcggttttttcatttccacaatatcatttaagtcgtacattccgcttacccctaatctaatgaaatattcagtaaattcaaaatgcggttcaaatcgtcattagaaacataattaatttcgatttttccgcctttttctttctgatccaaaactgctttggtaccaaatctttcttgtaattgttcttcaattgcccgcacatagggtgattccttacgaacgggtaaaaccggtttcccctttttaggcatttgtgcgttcaaacgattaactaagttctctaattgccgaacggtcaaatgttcactgaccacgcgttttgccagtggaatcagtttatgccgattcttcaaagcaagcaaggttcgtgcctgacccatcgaaagttcaccagcctgcaacatattttttattgtttgtggtaaacgtaacaaacgcaggtaatttgcgatgtaaggacgacttttacctagtttttcagaaacttgtgcttgcgtaaaattcagtttggccattaaagaatcataggcttgagcttcttcaagcggcgtcaaatcttcacgctggaggttttcaattacggccgcttccattgtctctgcatcgcttaattggctgatcaaagcaggaatggtgtgcaatccagccattttagcagctcgaaaacgtcgttcacctgctattaattcatagtaattcttggcagcctcttgtttacgtacgataattggctgaaacacaccagattcttgaatagaattggcaagttcacgcaacgctttggcatcaaaattatgacgtggctgatacggattgggatgaatataacttaaattgatttcaacgacttgtttggaatcttcgtcccgcaaaagtttttcagcacccattgaagttttagctttgcttgtcattctttacgacttccttttttcgtactcacaatcggttctcggttaggtgttcccggttttcgtggatattttttgggcgtttttgtcactttctcaatccaaaccaaatggcgctcatcgccggaaactggcaaacttagttgttcgtctttaattaatttaccacccagaatttgaattgctttgtcagcatcttccacttcatcttctgtatgacttgcctttaatgccagcatttgaccgccaatcttaaccagtggcaaacacaattccgtcaaaacagataagcgagcaaccgcccgggccgtgactaaatcaaaggattcacgataagctagtttgggagcggcaaaggtttcagctcgatcgtgacacaaggtgacgtcacttaactccagtttttgaatcaagttgtgaaggaaagtgatccgcttgtttaacgaatccacaattgtcacctttaactgcggaaaaacaattttcaaagggattgatggaaatccagcgccagcacccacatcacacaaagtgattggttgctgaaacaccgctggattttgaattccaggtagcaaagagtcatagaaatgcttcaaataaacatcttcctcatcggtaattgccgttaagttgacatgttcattaatcatgactaaatatttataatatgtattaaattgctgcatctgtttatcagataaattaatgccttgggcagcgagggcttgtttaaatgcttctgggttcatataatcctccattgtgaaacaaaaagtgttccacatcattataaacgatttttaatgccggaacaagataacttactaatcaattgacgcggcgaattcctattatatcagtttttgaggcaagttttccaaaccaaagcgatttgagcatggtaaaatttaactgctagtcaaaattaagaaattaaggacaactcgaatgttaaatacatggcttcaagggttattatttggtgtcgcgtatatcgcaccaattgggttacaaaatttatatatgatcaacaccgctttagcccagccccgtcgcagagcgctaagggtggcgttaattgtaactttctttgatatttcacttgcggtgtcatgcttttatggcattggcaagctgcttgaactgtattcctggcttgagctagtcgtacttgcaattgggagtattattgtaatgtacattggtattacgttgttgctatcacacagtcaaagtgccagtcatcataatcatagcggccagtttagctacaaaagtgtagttgtttctgcctttagtgtggcttggctaaatccacaggccatattagatggcaccatgttacttggcgccttccgggtttcgttggcgtctaatgtgcaaaactatttcattttaggcgttgcgatggcttagattatctggttttcaagtttgactaccattatttcggccttaaaggatcgttttcagccgcgctttttagtactgttaaatcgaatttgcggcattattatcactgtgtatggtattaaactgctggtgacattttttcaaaaactttgattgcaaaaggccctcaaaattaatttgagagccttttataattcaacaaaaccatcaattatccaaaaaaaatcaaacctattctgtcataagaaacaggtttggtcttttatacaaattttttaaaaatctacagcaattctttaataagcgtgcaatacagacattaatcacatcaaaagtagctctttcatctttagtcagctatattgaagtatccttaatctatcaacatatacggatattttatcaatattacttagttcatgttccaaattaaaattgccgttgccactattgcagcaacacccaaactcatcagatctgctttagaatatttactcttggtgttttttttacgtccccgtggcttaatggttgccatgtagaggacaattaaaattattgcaccaaaaatcattagtccatattgcatattatcaattcctttacgctaaatttgattacactactacaaagatccactatataaaatacttaactcaattcattgtgaaaatatcaagtaactaagtaatttaagaaaataccaatatacatttcacaattcatcaaatcatctgctactgttacactaaattacagcatcaattatttttctttatcttcaagtactttaattcgcttgagcattcgtattaagtactttgtctcatcaattaacaacatggtggtcatcagtgtgtcctgcccatgaaccataatgaaagttacatccatattttctccgccggcttcttcacttaaaatcttactttgctgattgtgggcatcgttaatgtcattttgagcttctttgactttttcttccgcagtcgtaaagtcgccagcctcagcggcatctaaggcatgcaaagcagcagtacgcgcatcaccggcgtatgcaacaagtgcaaatccaaccatcgaaatttctttttttgttgccatattctttccctccgatactttcgaacacgctgaacggctcgaatttttaaattgtatataaaatgatcttaatctggaatcacatgagtatccgaaacatttttaaaccaacttgcactttctttaacatagcgtttttgtgttgtaaaatcaacgaagaataacccataacgtttactgtacccatttgtccaagaaaattgatcctgcaaagaccagatgaagtatcctttcacgttagcaccatccgaaatggcatcggcaacggctccaagatattttcccagatagtcaatacgttttggatcagcgatcacggtttcagaagttgcatcttttgacaatgcttccttaagcccaatcccattttcggtaacataaatatctggaaccaagggatattcgtcgtgaatacgcatcagaatatcatgcatgcctcgtggataaattgcccaatcccaatctgtagtttcaatgttatctggttttttctcttcaccaataccatgcaaacgagagacagaagttcctttagcaccggtaccattgtgaaccctctctgaatctccatgatattcacgtaaccatttactgaaatagttattaactccaacaaagtcaagttgatgggcagctttgtcaagatcttcaagttcttccggtgtcgacttaaacatcttctgatcgtttttatttaaaatctcctcaacaagtgacaacgtttctggagcatatttaccggccaaggtaccgtcaagatataaacgattttctaatgcatcttgtaacgcagcagcgtgcttgtcaccttcactatcagaatatgggtacaccgtttggagcgcgtgtacgattccaatctcgccgcccaggtgcattgctttataagcatttacaatttttgcatgagcaaccatttgattatgttcagcctgaaatgttttatcaaaacggccagtttcagcaggaggaaatgttccacttgtatattgctgaactgccattgatgttggctcattaattgtgatccaatattttacttctggaaattctttaaagcagaatttagcataatcaacgaaatcatcaagcatttcttgactcaaccaatctcccgctaaatgcagacgttctggcgtatcaaagtgatgtaacgtaacaaacggttcaacaccatgttttttgcaagaagcaaatagtttgtggtagtaatcaaccccacgagattcaacttttcctgctccatctgggaaaatacgagaccaagcaattgaaagtcgaacggcttgtacgccatatttttcagatagtgctaaatcttcattatagcgatgataaaaatctgcagctggatctggagaaaatcgtccttgtttttcaagaaaatcgtcccaaagtactcgaccctttccatcttctttagttgctccttcaacttgatatgcggcagtagcgccgcccatcaaaaagccttttggtaatgtcttactcatgagttatcctcctaatttgatttaaagattagattcaacaaagtctagagccatatcaccattattagttagctcaatgtactgacgaccggttgtagtgactaacttaacatcatatttatcggtaattttttgtaaattacccttcatactttccatctgtggagcaagaataaccatgtccatgtcttgaatcatatccatatcctgtccataagcacgagcggttgcagaaagctttaaaccacgttctttggacagtttattcaaagcattggcaaggattcctgatgttcccccgccagcacaaagaacaagcacatcaacctcattgttcttgaagtactcttcaccatgttcatcatggcctaccgcggtagtcgaagtatcagtatcaggggcagctggcatttcaacatcaacatttgcagctggagtttctgtaacattagcaaaggccaaatcaccttttgctgccaatgcttgtgccttagctttttcttctgctactagctgtttatcatattgatggaagaatggtagaaagattataacatcgagaaccaaaattattgcaacaaagacaaatgaaagcggcgcaaacccggttgcggctacaataccaattggtgccggaaccgtccaaggcaggtagtacatcataccattcatacccaaagtagtgacaaaaaacttaaatagagaaatattgaccattggagtaatcatgaatggtactaagaaaatagggttcatgataattggtaatccaaataatactggttcattaacagagaatgacgctggaataattgcagctttacccacagccttaagttgcgcagattttgcagcaataactaaaacataagcaattatgaatgttgatccagtaccaccaaaattcataacataatccatggcattttgtgcaaaaacgtgagttacatgtgcaccagcctgatactgaacaaggttagcagctgtgttagcaatcataatcggtgttacggctggtgaaacaattgaaggtccttgtacaccacagaaccagaagaacgccatcgcaccagcaatgatacacaaaccaatgtaagtatcactagcctgaaagactggggacaacacattgatgatccaccgtggcaaaactgtaccagtagctgctttaaagagaaaaccaaatgcccagaaaactgtgatagaaacgcccaatggaatcaaatctttgaacgcttgagcaatattacctggtacttgaggtggtaatttaaccgtaatattatttttgatacaaacgtagtaaatatttggaacaatcaaaccaacaatatatgcacaaatcagaccttgagttccaagataagttaaatctacccctgtcttcaaaggcacaattgacaaaacaatgaatgcgatctcggaagcaataataactgccaccggattaatttgatttgttttggggaggtcaagatttttactgtcagtcaaatttttggctgtagttccggcaacaaataacgccaaaagacccattgaataattgtacgcaattaatagtgtgttagttacattatctggccagtaaaatccccaagcattaggaacataagcaatcatcataaaaatactagaaaagatgatgattggcatgcaagcaataaagccatcacgtacagcggatacatatctattcgcggcgatagcctcaaatgctggtttgagtttatcaaatatcttgttcatgttttttcctcctaagtttgtttaaagccgcagcggatttctaataagtattaattcagattagtgcagaaattatttatgaattaaatacaaaatagttcttactattcccgctactataacgaatatatttctattacaagctaaactacattagcttgcattttctaaatcaacattaatgttactttcccatcaaccttttattaattggtggttcctcaatcaagcgttgaatgtgaatgataaaatacagacgttcatcctcgcttataccaggatacaaatccttcttaatttcattaaaaatttctgaagcaatagcatacgatttcggatagttctgttcgagttctgttgcaacctgtggaataatagtcgttgactccacgtcagtctgctgtattcgatcgaccagatattgaaggtggatcataaaacgatcataataattgctattactcgttggtctcaatattccatgacgtttcaatacacgttgagctatattatcgattgttgtttcactttttttactaaatttctgttcactatctgtttcaccagttgcattgatgaaatgtagcgcaatgtttttagcttctgatcggggaaactgaacaccaaggtttgtagcaataatctgtaaggcttgctcagcgactgcatattcagttggatattgaacatgaaaatctgggaccatactgtcctcatatgtgtgatctttataacgcttgtatgcaccaaagatatgatcactcaaggtaatataaatataatctaaaaccttgagatgatactgttgttgcgcaacatctataatttcataagtggtcgtcaccacatcaatcggaatatcttttaagagaaagtacaaattctcacgtgaggtctctgtttcaagtacaaatagtttttcgacctttttgggtgaaatcatgctaccacgcttttttttaaacgctactccacgaccttttgcaatcgcctgacgatggttgtctagatcaaccaaagctgcattgttattaagaatctgggatatcctgagcatgtatttcacctcctaagacatagaaaagaccacaaatcatcacactgaacacagtgtcataatttgtggtctcgcctaatttaatagtaacaatccacaacagatattcctctcgacaagttcagtatatcacaatcagcggcaatgtaaacgtttttttataattttttgttccattttgttcatttgtgttctttgtccttactttacttagcgaaaatattaacgacaagtattgatactacagtgttagacgcaagcaattcactgtgtcttctaaaggtgatagataatccataatgaagatgtagtgagacgcaaaaaaggcttttgaaatcaaaatttactttatagcttccttggcaatcttggttgttgtttccgcactgtttccactgacttgaacaactttattcttttgttgccaactaatattattaactggtttctgctgagcaccatcataaacaaccacgttgcctcgagtgacattctgagtaataaccttattactctttaaagattcttgcactttgttcgcgacggctgtcacagttttgttagtttgattaaccgaagaagtcgttaaatcttctgtatcggccactgtggttacagtccaaccattcttttgccattgaacataaacatggcccatgaccccttggctagttgctttggtaccatctgacaacgtaactttagtcccatccgcatttgttagattctgagtgttttcaaaaccagtcttagcctggttagtagttccatatttttgctgtttataggttgccgttgttgcactattagcaccgtttgaatacgttactttgccgctagtactatttccagtgacggtttgggcttcagtttgtgtcccatcaactttttccggagcagctaagcccttgctggcaggtgttgtcactgcatgaacagtgacattgttggttgtcatggtcgccccgccaattccaagcaaggctaaaccaaagacaaaactgcatcccattaccacgattcttttttgttttttcatatgattaacctccctcaattagttgtgacaacatttttatttacatatccgacccaagttttcccactatacaaagagtaataggtgtggccatttggatggttttaataatatttcactgtataggtttttccgtaataattattggtactgcctaattttttagtgaaggatagattcttccaaatagtttgatttttcaaagcaattttagccgtttttttagtgctaattgccttccaagtcgccttggcattgacataaccaaaccacgtacttcctttataaagtgagtagtaagcctgaccgttaccacgaatgtactggtatttaattgtataactcttattcatataattcttagtgtagtgttttaccttggcccataagaaattattccaaacactgtaagttgatttgtgaattgtggccgtatgtttgtaactgtggcctgtcatcactgtcatagctttagaatttacataaccaacccatttgttgttcttattgtacaaggataaataagtactaccatttttgtgcttatacaaatacttagcatagtatgttttacccgcagttcccgttttcccaaacttagcggaaaaagcaaaattcttccaaattgtgtctccagctttggcgctattctcagtcacatacttattatatttgctagcagtggcatagttacttgcagccgtgctagtggataagaaccaagaagttgcctttccatatttcaaacttgcatccacatattgtgcgattggggagctataccagtcatcggaaaattgccaaagcacatgcgaaatagcggttggttcgattgacgtataatctgctaaccaaaaaccgtcgtagctcttcatagctgatgccgcataggtctgtgcaaagctattataggagtaaaacaacacatgcttggcggttaaactgttaagttctgtataccactcttttgtggcagagttggtagtaccgcttgtcactgtttgttcttcgtaatcattaacgtaaaaactcgcgttaggtgcccgcgtgtaaagatctttagcttcttgtttggcatctgaagtgcttatgtactgactaaatgaataaacgccgtatttcaagccatattgctcacacaaagcggcattttgcgcaaaatacttatctttgtaatcactaccatattgaactcgtaaaataatgaacggttcaactttggccaaatttttaacctgtgttgctgttagttttccttgccattccgacaaatctggaacttgtgaattaagcgtagcggcgtgggttgtttgcatggtaaaaccagcgaatatcaaaaatcccataaccactagtataaatttcaggctccagttctttttccatgtcggatgcatatgtactgaattcatataaagactccctttctaagtaaaagaggaattcccttaaaaaaatcaatatggacagatcgtgtaagcatcctttacagcaacccgttttcgtgccttatattgcaaaaaatccctgataatgatattatcggggatttttagttgtgctatttaattttattggttgtttttaaggaaatcccgagataaattaggacctaacgtcccttaaaaataggttactaaataaatattaaatgaatattaaaataaccggattcagaactactttttaattaaactaaataagttttactgtttgtttagttttggctaatgaataaaaatctttgaattatctatattaataattagtcagaagttaattgtttaaattcaccaattatttaattccaattgcgtcacgtacaaatccatttgcatcaatcaatcgttgccgtgcctctttggccgaataattgcctaagcacataacaattgccactttgctattttgaccagcctggtcaaaatattcacctgcttcttcttcactaataccagttgcgagaacaatcatatgtttagctcgaatttttaatttttcatttgttgactttacatctaccattaagtttccgtaagtcttgccaattttaaccattgaaacagttgacagcatatttaaaatcattttttcggctgttccagctttgagccgcgtagacccggataacacttcaggcccaacatctacttcaatatttttgtcggcgtacttgctaacttctgcatgaacattacatgctacactagcggtttttgcgcccatttgatgagccatttttaaacccgctataacatatggtgttctaccactggctgcaattcctataacaatgtctttctttgtcaaatgaagattttcaatatcctggttcgcaagtttttcagaatcttctgcaccttcaaccgcgacggtcattgcctttttcccaccagctattaatccctgcaccatttctggatcggtaccaaaagttggtacacattctgatgcatcaagaactcccaatcggccgctagtgccggctcccatatagattaagcgtccacccatttgaaatgtgctcacaataagtttaaccacactctctatttgatccagtgcgtgatcaatgctctgactaaccttctggtcttctttattcataacttccaatatttgataaacggtcatttcatctaaatgcattgtatttggatttcgtttttccgttgttaaattatttatttcattcatctgagtgactcccttactgccaactttgatacgcataaaaagcagccttagcattattttgattttttatagcctttgtataaagtacattatcacattttctttgaacacgagcccggagcgtttcttcatacaaagcgttatgctcaacaagagatcctgaaagcccaattgtcaccgacccttttatattaagtcttgatatacctaaaatgacctgtcttgatagcgcagttgcagcgtttcgaatcagcaattgagcatcttcatccaattgatcagaacgagcagctacaaacaaggcctgctgcccaacttcacttttacttttggaatagaaatcattaacagcactgaacacatttgatacgcccaaatgtttcataaactcattagaaaaatcggtatattgtccttcatcataatcatctgtcacttttttatatgctgatctgccaagaaaatatccaccgccttcatcaccaagtaaatgtccccatccacctatacgaattttttgcagcccttgttgccccaaaacaactgtccctgttccagcaataactaataacccgtcttgcccacgtaacacattaatcaaagcaatatccgcatcactaacaagacgcacattcatatcttctaagcctaacttttttattattttatcttgttgtccatacacaccaagccctgcaaaaccaatcaggattaacttacattctttacgatttaagcttttgaaaaattgacttaagatcaaagagacattttcaaatgcttgattggcattagccatcagatttgcttgtcccccatgaaaatgatattcttcttttcctttttgattatatgcatagccttctgtatgtgttccgccacaatcaataccaatcacataatctgccaaaatgtctcactccttttttgcctatgtaaggaaatatcaacagtgatatttccaataatactagtttgtctcaaacctgaactttgtccatggcttaatataatccaataaaaatagttctttgggggtaatcttaccaactacatttttatgttgatcaacattaggaatatcttttttaacaatgttaacctcacccttatactgtccaaaagagtcattgccaataacaacatctcccggatgaagcttctctgacgtattatttttaggaatgccagtttccttatactgtagttttacatatgttgaacgaatactataactattaacatcaccacgattaaagtgcaaatgttccaaaataatttcacgttcaattttggttgtacttggatcaagttcgatattcaacacaagtaattgctcattaactcgggataacttttttagttcctcttcacttgcaaattcattaccaataatcacatcatcaatcaatccagtagcaaaaagatgcttagcctgaacttcgattggtaaattacgatgcatttctaatgtaggtaaaccattgttaaatgggtgtggccctaattttgcaacttgtgatgaaacaaatgctgcagtatgaagcccaagatctttatatttttgagtgcatttcataaagaaatcagtatccaatcccgtataaggttgtggataaaaattgtgacatccaagaatcttttgtttattgggtgcatatgaaagaatgttttcaatatttcctgcatctgagcttatattaagttcaacgtctagtccagaatctccataactaatcagagactcagttaaaccatcaaagttagcatctagtcgaattgcatcggcaccaatatccttgaatagatttaagttctgataactaacccctaacgtatcgaacactctcggattggcatcaatcgtaatatacatgtccaagctgtgcgctttagaaaataccttcttaaacaaactaagaatgtcatctttgttactatcattaacatctaacaagctagcaaatattctcttaaaaccatatttatgtgctaactgaatatattcaatagttgatgtaagatcactttttgttggataaattgatattcctaacatattgtttctcctatcatttgcaaatttctacagatcttcaattactttattgctgttaatttcagattgcttttttgctttttcagcatctttctttgcagcttgttcctctttacgtaattggtcgttgtcccaagccttaaagaatggccaatagatagcaactgccatcaacaagttgatcgtgcataaaactgccgctcgccaatcaaacccagtagccataaatgcacctacaggccctggtaatgtccaaggaacaagtgcaattgttctatttaccagatgtagtacagttgcaagccaagttaaaattcccatgcttaaaggcgcaagtacaaacggaatcgcaaaatatggattcataacaattggtacaccaaaaattattggttcgttaatattgaaaattcctggaatgattgtagctttccctagagttttaccaaatgtggatttggcaaaaaatgccagcaaaatacataatgcaagggttgccccagcaccgcccacataaacgaaccattggaaaaattgttcggtcatatagtgtggtgcagttgctgcagtagcgccttttgcgactgctgccatattagcattcaagttaggataccaaagtggccagaaaattggagtggctaatgcagctccgtgaataccaaacaaccaaacaatatttacaagtaaaatcggaacaattactgaagctaagttatctgtaccaaagtgagctaatggtgaaaatacccattgaaggccggcatttacatcaaaatgaagtccaactctaataatccaagcaccaataattagaaatactgatggaactaaagcggcaaatgaattaataactgccggtggaactccatctggtagtttaataactaaattccttttgcggcaccatctaataacatctgcagtcaaaattgccgcaagcattgctgtaaatagcccagctgccccaaaatttgttgtcggtaacactgttcctgccgccattttagacagctttgccgactgtgctgtgagtgtccctggcgtgattgcaagaattaggtatgtcattagagcaacaaccccagttgaaactttatcaaacccataattgtctgccaaattggcggcaattgcatagcatgcataaactgacatgaatccaattgaaaaatttaccggaattgctaaaccggctgcatatggtttaacaaaatttgtccacgctgtaattggcaactgtgtaatgatcgtaaagaaagatccaacaattgcgactggaataatgactgccattccgtttttgatagcgactaaataacgattgccggcaatttttcccattactgaaataatcttatcggaattgaaatgtgactttacatttgaaaacatttatattcatcccctaagtgtaatcttaaaaaatccgtcagaatcaaagcaacacatttgtatttataataatggctgtagcaacaatgtttttttgaatcaagaaattaggtctgccctccttaacttaatgtgttatctttgttcacagaaaatagtatcacatttttaaagtattgtaaacgcaaacattgcttttttaaaggctttatgagataatttatttgtaaatttaaaagttaacaccttaacctttccgagaaaaggagaagtattatgcaaaaaaaagaaccaaagtatctgaccattatccaagccttagaaactgaactcaattcttcaaaattcaaaaaaaacgaccccttttatagtgaaagtgatctaaaaaagaagtaccatgtcagctcaactactgctgttagagttcttaatcagcttgcagacaaaaaatatattactcgtattcaaggaaaggggacgtttgtttccaaatttaatttgagcacgtcggttcgaattaccgatacacatccgtatgatactactcaagaaaccgtcaaaatattggatgctcatttagctagtaaggcaccatctaattttggcgagaattatcatgaagaagtttggtcaatcgagagaatccgtaccgttcaaagtgcttttcaatattcaaaatcttggtttaacaaaaatttgctttcatccgaagctattgaaaatgcaactcatataaattctatttacgaacttattagagaatattcaaaaatggatatgtataaacaacaatttattcaaaactattccatcagtactgctccgaccaaaaaaattagcaagctattaaaagtatcttccgttgatttacttgtccatgaagaacgctgggtagaaaagaataatgaaatattggaatatacagacagttatctgttaccaaaatattttggattgcacattgtaagttagcaaacaaattggaggcatagctttgagcattaataaaatttcttattattccgatacgttgaaaaaaataacaaatgttaccataataatcccagaaacatccaatactgtgtcagatacgttccctgttttatggcttttacatggcctgggaggcgataactctgtgtggttacgaagaacttcaattgaagagtacgcagacaaatatcagattgccgtcattatgcctgacgctcaacgcagcttctataccgatatgagttttggcggagactactggacctacatcacacaagaattatatacaaaaatatattcaacttttccgctatcaccgcttcgagaaaataattttatatgtggggcctccatgggtggttatggagctcttaaatgggctcttacctaccccgaaaagttttctgcagtagcagcactgtctccagttctagatctacgggattttgaaacacgtgaattattatcaaaaaaagaatttgccggaatctttcatggcaaagatcttgaaaaaggtccattggtaattagctggttgattaaacaatacaatctcacttcaagctctaaactatcagtgttgactgcttctggaacaaaagattttttgcttaaccaaaatcaagctttttcatcaatatttcaaaataaatttaaacgaaattatacatggatgaagactgaaggcgcacatgattggaacctttggcgtcctcaattaaagaaagtcatggaatggttaccggttaaggagacaaatgttgaaaactaaaaatattagagctactttcttaaataccctgtttgctttcatcccattattatttgcatcaattttatatgcatttttaccagacaaaattttcgtgccttcaagtgtcagtggtatgcaacaattcgggacaaaaaataacatttttgttttcccaatattttgtattttggcttggattgtctgctggtttttcattagaattaatcgcattcgtgaacgaaatgacaaaaaagttgaaaaagttcatgttaagtccattgaaagttattatgtactagcaagttgggtagtagatgttattgcgtttctcgccgtattatgtcagtttttaattcgttagaaatcaactgaaccagcaaaaaaatagactcccgtaacagacagttacaggagtctatttttcattctacaaactatggttaaacaatactgacttctcttattctccactaacttccttcacccgaaatgccacaatctcgcgaatcagttttactggtaatggctggtcataaggaatctggatggttcctttagaagtctgaaagtcctttaattgtgcttcaaaggccacaatcggagcgggcgttggataaaaaccaagatgtttttgcgttgccacaaaatacaccaaaactttcccattttgcttaatagccggcatattatacgatagaacctcttttgcatcgggagccgcatctgccaataagtcacgcataatttgcgccacattttgttgcatttctggtaatcctgccatgtactctgcaacatttgcatatttctccatagttaacatcctttactttctctgggaattcagtgttactcacacaccattcagttataaacttctctttgaaaccaattataaccttcttcacgccattattctcacccaaggacactaaaaaatcgattaagttatcaggcacgcaagcccgacatatttaatcgattttcaactttttctatttaactaactttacttgtaccattaacgtaattgagttttacccctttttgaacattgaaaatataaacattgtatctaatacgatttgagccaatcgattgtgcccgcatttctactccattagctagcaagtcgcgacccgaataaactggtttgacttcataacgcacataatggtgagaactttgccgtaaatacttagctgtttcattttcatacttcgtcatttgcggatcgtttagtgaacgggttccagtaattaaattcttccaattattgttttgtcctgtcaactgatacccaatcaaatgacaccggttatagagccaaccagacttcaacttcttgttgtgccacccagttgggtctacgtaaagtgacgcacgggcttttttaggcatcaatcgtttattcagcatagcattcgcatcagttgcccgattctcgctatccaaattactatatttttgccatgcaccttttttggtggacaaagttgccttggaaaaattagggcgatccttattgatgatcactgtttgcgtcccgtggtacttaagtgtgctcagtttagaagtcgttgctgccttggccttttttgccgaaacttttttaacaaccttatggacaacttttttcttgtggacgactttctttttcttaacaacctttttctttttatgcacgactttcttcttgtgaaccacttttttctttggtgctttttcagtggttgacaaagttaatccccgtcgtttagctgttgttaaacttactttacaaacttttttagctcgatttagaccccgatcgtgccgtttataaaagtaatgcttccctgttctagtcacataaacataggtcgtggcttgcgtagttttggtgttgcttggtaactgttgcacattaaacgccaatgtaaatgtggcaatcactagtatgactagctttgaaacttttttcatgctgctcccctactttctaccaccgcgaatggtaaataactaaaggttgaaagtatcaaaatcacttcaataattaatattaaacgacttggttcaaaagcagtagtttaattgccgtcctacgcctcacttagtctggaagcaaatgggctcagtagtatcattaaatatacttctgacgaaaaatttagcattacagcttatgataatttgcgatatttaaaaaatgaggacacgttagtttttccttcttcaacactgacccaacgatttacccaagtatgcaaattagctaaaattccccataaagctaaggtggtaaccaagcataaattatcgccggttttaaatgatgataaaagttattttgacatgttaaagtccagtattaaggaagctcgtaaagccaatggcaatcattactttgttgccgatcattatggcacagttgaattacgtaaggcaccgtattatcggactaaaattattttaggagataaatccagtgctgaaagctttacatttgagaagtcgattgataatgcttataacgccatcaaagtggttaaaactagtaagaaggaaaaggctaaagtaacggccactaaaattgtccaagctggtaagcagggcaacacattgcaacgttggggaaaactgcaaaagattgaaaaagtaactaaagacaaaactaatctagctcaaatgaaagttcgggctagtaatttgttgaaactatataatcggcaaacctataaattgagtattacttgtacaggtaatcaagcattaagggctggtaattcagtatatgtaaaactatccagtttaaaagatattggtttgggaaccaagcaattggttattaccaaatcaaccatcacatttgacccgaattacactgctgatttagaaatcaaggtgagaatgtcatgacaggtgatacattattagacatgattaatagccgtggaggaaatcccaatgagtatagtgacatcgttccaggaaaagtgattagcatttcaccattaagaattcaatattcatcaacggcaattttaaccgaagactttttaactttaggagaacacgtgactaagcatacagttaaaatgacttaccaagatcgttcagagagcggtgatatcaaacgaacagaaaccgttacaattgatcaatcgttaaaagttggtgatggcgtattaatgttgcgtggtgatggtggtcaacgttttttagttttagaaaagttaggtgacacaaattgaatgatgaattagatgaagttcaagatttaatagatgatgctagcattccagtggtaactgaaacggaggcagacgatgatatcgatcaaaaccttaacgatgatggcagtccaaccacaggtgaaactgatgatgtggaagaagaaacttcccccacctacacataccaggttaaggctggacgaattattcagatgacagatggtaaagacgcaatgctacaggcaatcgataaattactacaaacggttcgatttgcttatccaatctatgatgaagattatggtcatgatttagaagatctgttaggcaaagagttaccgtatgctcaaacagaagtcgaacgattactaacagaggctttagaagcagatgaccgagttttagatgtggaagtacaagatattgtgcctgacactaaaggttttctgactgtaacggcattggttaccacgatttatggagaaattagtattagtccggaggtgatgattaatgagtcctagtgaattagttgcagaaattcgtagtcatgattttgattactatctagatgaattgatggataacgttagtgacgatgtggataaacgagaggggtccattatttatgatgctttggctcctgctgcaacggttttggccgaagaagcaattactttggctaacacgattgaatttatttatacgcaaacttccacgggtgagtttctagattaccgtgctgttgaacgaggaaccagtcgaatcgctgccaccaaaacgcaagttaaagccactgctgttgatcgaaataatctacctgttacaaatattcaaattggtgatcggttcgcttcgattggggatgaaccgattttttataccgtcattaaagtaaccgatgatattaaaacgcagcttagttcgtcacaggcaattgctgacaaaggcggagcaactttttcagctatggctactgatgtcaccgcacccgtaattattttagaagcagaagagttgggcacgaggcccaatggatacaaaggccaaatcttaccagtttcctataacgatgccttaagctatgccgaaattacagaaataacggtacccgctagagacagtgaaagtgacgatgatttacgaacacgtttattgtctccggacacttacaatgcttatggtggtaatattgcagaccacgttgatatgttgtcccgaattaaagaagttggtgcgggacaagtttatccagcttggcaaggtggtggaactgtaaaactagtcatcgtggataataatttcttacctgcttcaactgaattaatcgcttcggttcaaaatgaaattgaccccgctccaggaggaagtggttacggattagctcctattgaccacgttgttacggttactgcaccaactgaattaaaaatagatattaccagtacaattacgtttgctacaggcattgatgaaacaactgtaaaaaataatattaatcaagcattacaaacttactttggtaatttaagaaaaaattgggcagtaattgatgctaccattggccgtggatacaacgtaactgtttatcgttcacagatcttggcggaggttttaaaaattaatggggtaaccaatgctactttgccgactttaaatggtcaggactctgatttgaaattacaagcgactaataaaatttcggaattaccaattttagggacggtgacattgaatgactaaattaatggattacttaccggattattaccaaggtgttcgggaaatggaccgattgctgaatggagagcaattgacactggatgaactagagacatttgtacgtcaatttttaagcaatcaatttgtaactactgcagatgaagctggaataaagttaatggagtccgagttaagtattattcccaatagtactgatacgttgcaacagcgtaagaatgtaatcttgctacgactattaccgcccgcagccattacatggccatactttaagcaactaatccagaacctgaatattccgattgatcttcaacgagatgtcataaagcaaacagtttcggcgatgttttataataggctaccaacttcaacagagattaaacagcttcaatatatttttaatacattgattccagcaaatatggtgactaaattatttacaccaactgaaacccaagtcagctttaagcaatactatggcattgctacggtaattcaggttgaaacagtagtaaatgcgaaaggagcaaattaatgagtgagtatcatgattcccaactaaccgctttcggtgctgatttagctcaacgagccagtaacggtgatactaaattcacaattaccaaagcgacgtctacagcggatgatttaagccaaacggatttaagccaattaattacattaccacatgaaaagcagactggtgaaattgatcgaattttgcctgatccaaatggtggaacgaaagttaaaggaactaaagttagttttgataatttaaacttaactgaaaactatcccattcaggcgatgggattgtatgccaaagaagatgtcgatggagctaaagagcaactttatgcagttaccactgcggctgatccagaaacaatgcccaagtctgattctgccattatgtttacttttgccgtttcgatttacgttgtggttggtaatgccaaacaggttacgattaacgtaaatcctgatagttttgcaactaaggaatatgtagctgatgccattgctaacgttaaggttgatacgtctgatttagcgaagttaaaccaagataattactatactggtgataatcaatttaagcatgatccagtcaataagaacggtgatgcttatggattagcgaaagacattgatactaaagtaactgacaatggcgatggatccatcgtagtaaacgggaagacctttgtaccggctgatgacagtcaagttgtgcatacttccggtgatgaggaagtcggcggtaccaaaacgtttgacaccgcaccagtcgacaagaccaccggtcatccatatatcaccaaagatggtgtgccagcggtaccatcaactcttgcagataccactaaaatggccaacttcactggtggactgcagaaaggaggtatcgatgtcgccacggcggctgacttaaaaagcgttgaaaattctgcttggcgtgtaaaacaaggatcatcagatcttatgacgtcatacacttgcctttataggatcaactccgataaaaggcgaattgagtttgttttatggggattattgccagccggagatccaacaggaaaaacaattgttgatttttctgaaatctcaagcacctttaagtctatcgatgggaatgcaacccagggcttaaattcggattatgctatgaaacgtattatacaagttaatgggtctaagatatcaatatctgacagtggtacttccggaaatccaactcgtctttttattgctcatcatagtcttattaacccatcaggggattatagtggagacaatgagccttgctatttgtactattaatttttagtttaatttttttgctaaaattatgctataatatttcacgtggataacagcgcattcactgttgttattcatacccttcaagtgtatattcccccagaatatatacctctagatatattcatactttttcatatatcccctaaaagtatatgaaaatgcatctatctacggataggtgcttttgttttgctgaatacagttttgaatcagataagttttagaagcaattgctgctgtaaacgagtattaggttaaatgcttgacacagtttacacttcgcaaatacactgggagtacgcaataattcttatatggaaaaggagacttatcaaatggctattttatctgaaagtatgaaagaaatgattggtaagcaattaccatttctggcaactgcagatgagcatggagtgcccaaggttggccccaagggatcattgcatgtactggacgattcacatcttttgtattttgagcatacctttcgacatgcctatcacaacttgcagcaaaacaactatgcggcagtagcagtggctgatagagaggctcagaagggctttcgatttgaaggaacagctcggatttatgaaaatgattccgtatctaaaaagtatttacccccgaaaatttttgaccgttttccacgtgcagcagtggtcattattgatgtggaacacatctttaagttggataatactttagaagcgggcacacaaatcagttaacattatcagcataacaatatatacaaattagctgtctatgaaaatagatggcttttcttttgcacagaaatagaagggaagtgagaccgttgccattaagcgatgaggatcatcaaatgttactgaaacatggcaaagaattatcagaccatgaaagacgcattactgatctcaacaataaaatgactgacactttaaagagtgttgatgaaagtaataagtatttacgagaacagaatactcgaattttagaagctgtcattcgtggaaacgaaaaaaatgaaactcataaaaacgagatggaagttatcaatcgtcaaaacctgtggaaggtggtaactattgcgattggttcaagttccgtgatttatttgattctacaacagttaatgcactttattcattaggaggatgttatggattttattcaacaattaaatttgggaacgactgcagaaatgtcattaatctttgcagtcgttttttgtataactcaggctttaaaaacgaccgtgttaaacaacaagtggctgccgtggatatctatgattgttggtgtgttcgcgggattattggctgccatcatcaatgccgacagtcattatttgtcaagtgctgtcctggggttgttaattggtggctttaccagcgggctttttgacggttttaagggattctcaacaaataaggaggataaaaacaatgggttataaaattaatcgcaattacgcactttcagcgggacaaggcgacagtcgattagcggctaaaaagtatattatcgtccacgatacggggaatgataataacaagggcgctaattcggctaagaatgaagcttcttatatgaagcaacactggaataatgcatacacccattttattgtggatgacacagcaatttatcaggttggtgaaccgggttatgtggcttggggtgctttgaacgctaatccatacagtccaatgcaagtagaattagcccatgttaattcacagtcacgattccgagagtcgtatacacgttatatttggcttattcgatactatgcaaacaagtacaatattccactcactcttgatggttctggtaatggtattaaatcacatctgtgggttactaataatttcggtggcgatcatgtggatccatacgggtatttatctaagtggggtgttagcaaagcgcagtttgctaaagacttaaagaatggggtggggagtacttctacaccaaagaaagcaagttacttcacctggcgcccacattggatttatacccaagcagcagttaaagcctataaagacattaaagatgttggaactggaaaaaatgtttccaagacttatccaccaaagacgcagttaagcactaaagatttaaaaaacaagagattccaattaacaaatggtctgtgggttaccgcaaataaagactttgtaaacaatctttactacacaccatctggcaaagtcaaaactgtgcagtctgtgcgtggaacatacagatacaaagatttagcctttaaacaaaaggttgacggattttctaaaggtacaaagtttgatgttgtgaaagttgttaagtacggccacacatcacggttacaattaggaaatggcatgtacatttctgggaacaaacttatcaataagtacgtagaataaacttttgcctcactcgattaatttcgggtggggctttttttgttatttctatatgtaagttgacatatatgtaggatgtcatataatgtatttaaaaggagatgtaatattgataaaccaaaacataaagatgttaattgctgataagtccattagtgcctacgagatagaaaagaaaactggagttagctcatccacaattataaatattagaaatggtaaacgatcaataaaaaacttatcacaggaaactggtgaaaaattaaatcattattatttggaaattcataaaccggaacaagtattttgggatgaagaagataaaaccatgttattatcagtcattaatgacgatccaaaacagcattgggtagtttccatacgggaagtaaggacgctaacagatactggggaagttgctgatagagaatatcccattgagattaagattccttcatataattctgtattgaatcatttggtgaataaatattggaataagtatgatacgttgcagaatcaaatatatgcagacaaaaattttccaattccaatacaaccgttttatgtggattatgctcaaatgtcttttatcaattcggaggaaatgctgcccattattgaaaaactaagaacatatttaaaagtacacaaaacaatttacggtgataaacttgaagaagataatgagacagtgttgcatcgcacgatgacagcctttttatatgctaatacttctaatccagattattcaaattgtcttattttaactcttgagccaattccaggcataatgagcctagcaagccatcagttataaataatgaaaaagcgcccacattggacgcctttttattggtatacttcttaaatcttctatgtaaaaatccgtcccagaaatcaaaatattttggtattcagtatggtattcaatcaatactttcactaacaaaaccttgtcatattaactgattgacaatttagactcgaacccagctagcccaattactaaacgtctgtgacgaaaggaactcgtcgcgggcgtttttttgtattttcaacgatcgaccattttgatattgcaaaattttgcattttccgctattgtcagtgttagaagaattggaatagtccgattgtaaattcaggaggtagcttatgaaaattggttttattggcgttggggcaatggctcaagcgatcattcaaggactgctgaaggcagaatttgttcctgctcaagacattttggtacacagtgctcaccaagatcattacgaaaaatatgcggctcaatatggcctgaccccgaaagaatcgaacacggcggttgttgacggcagtgatctggtggttttggcagtggtaccagccgttgtcaccgatgtggtggcggaaatccgtggtgaactgtcagccaagaagacgttgatctcaattgtttcaggggtttcgctggatcgattagaagagttgaccgattacaacctgccaattcttcgcagtctgccaaatatcaactctgaattcggtcaggggatgaccgcggttgcggccaacgagaacttaaccggggatcgaaaagctcaagccatctcgctatatcaagcaactggaagtgtgctagagcttaaagaaagccaattttcggtattcagcgccatttccggtagtgcggtagcgtatgttgacttctttatcgatagtctcagccgggccggggtcaagtatggcttcaccaaagaaatggccacccaaattgcggcccaaacaactcttggctctgcgcactcattgatggcatccaagaaatcgccagctgaaatgattgataaagtcagttcgccaggtggtgatactatcgccggcattctggcgatggaagaggctggattcctaccttctgtcatcaagggaattgacgcgacgattgccaagtcaaccggtaaccattagtcgacttgtggagcagatatgtcaacagtattaattcatgcaaagatctatacaggcaaacgaattatccaagacggctacctcagatttggtcaaacaattctcaacgttggccctacaaccagttttaaaccgcagtcaagtgatcggatcatcgatgcttctcaacgcacaattgtccctggcttcattgatgtgcatacacatggtggttatggtgcagattccatgaatttggatcctcaagtgattagccgaatcgtcaacctgatggctaacgagggggttaccggcgttttcttgactaccatgactcaaagtgccgatgccattgctaagagcatgcagacgattaaaatggcggctgaaaccaacccgcgaattttaggtattcatcttgaaggaccgtttatttcacccaagtaccacggcgcccagccgacggaaaagattcaaaagcttgacgttgataaaattgccaggtggaatattctctcgggtgggctggtcaaaattttgacctacgctccggaaatgcgcgttgacccaagagccgtcagttattgtcaagaacaagggattcaaatggcagttggccactctgatgcaacctatcagttgcttaatcaagctcggccaccgcacgttacccatttatttaacgcccagcgaggtctccatcagcgagaaatcggtgtggtggggtatgcgatgctttctcaagccaaagtggagttgatttgtgatgggttccatgtggtgcctgaagcggtacaaattgcttatcaaacgatcggtccggatcggctggaactgatcactgattccatggaagccaaagggcggccggatggcatgtatcagcttggcggccaaccggtcaatgtttttcggggaggggcaaccctggctaatgggcatttagcaggatcggttctcaagtatgcggacgcttttaaaaatattattcaatttaccgattgttcaattgcttcagccgtcaaaatgacctcgaccaatcaggcggaggaatttcacctgaaaggcaaaggattcattgagaatgggtatgatgccgatctaaatttgtttgacaatcacctagaccttatggcaacgtatagttatggcaaattagtgaataaaaactaagggagttggtatcagtgggtttaccaatttatattcaaattcataatgagattaaacgaaacattgaagcaaataggtggaaaattggtgatcgcattccctctgagcgtgagttatcgaccgactttggtgtgagtcggatgacgttgcgtcaagccattcaaaccctggtggacgaaggtattttagagcgtcgagtcggttcgggaacgtttgtggccaatcagaaagtgcaggagaaaatgtctggggttaccggcttcaccgatctgatgctggctcaggggaaaaagccttccagcaaaacaatttcgtatcacacgatggaaccatctttgagcgagatggaaaaattgcacatcagtcaggaacaagcggttttacggatggaacgaatccgttatggcgacgacattccgatttgctttgaagtcgccacggtgcctgaaaatattgtcgagggcttggaaaaatccgaagtaaccagttcgctttatcgaaccctggagcaaaagaagaacctgcaaatcggcaaggcccagcagacggtgtcggcgatgctggcatcggagcggattgctgaatatctgaacatcaaacggggcgacgccattttgagactcagacagattacttcactccaagacggtcgcccgttcgagtatgtccgcacccaatatgtgggtgatcggtttgaattttatttggaaaaagagtagtgggcgacgagacccgggagatgcgttttctaaggggactgggatttaaatcccggttttgagggatttgaatcccagtccccttagaagtgagcatctgggtcgtcggagccgtcctccaagaaatcaatccagcaacacaaaaacttttcacacaaaaaaccaggccatcacatttgttggcctggttttatcgtcctatgattgttttttctgatttttcttctttggctgatcataccgctgagcgtagccggatcgaatccaatcggtgacccaggccatcacagcagacataaacgcgaagataatccaagacgtccaatcacgataaccgccaatttgacgaagaatcaccatccacagcacaaagtaaatcacatagaagttaaatctgggcatccgcagataactggtgacataagccagcgcaaagattcccagcataccgtactgggtgtcttgaatggccgcctgatgatggagcaaattaacaatgatgccaacgccgacataaataattagaaaataggtccaaaacttcggtgaaactttcttcattgagccctcccggattttcgtgaatatttttgtttaacgatctgccacaaatattttggcagcaccatcagcctgccaaagcgactgggttccttgacgacccggtacaaccactccaaatgcattttctgccatgctttgggtgctcgtttgacagttccggctaagacgtcaaatgaaccgccaattccaatccaaagggcgtcggcagcccggcggttcttattgataaaggcttcctgcttgggataaccggttgcaacaaagaccatatccggctgggtccgtttgatatcgtggacaatgttgcgatcatcgccaaaatagccgtcgtgggtgccggcaatcgttagaaacggataattttcctggacgacttttttgagcttgcgaatcactgccggctgagcgccgacaaagtacgccgatttttggttggcgtttccccattccagtagatggacaaagagatcatatccggtcacccgttctttgagcggcgttttgagcatcttggcacccatgataatgccaataccgtcaggaacgatgtagtcagcggtcgtaatgagtttttcgtaatcgggattcgccttggcatacatgacgatctccggattggcggtgacgacaaacgtattttggtgttgattgatgacgttatgtaaaattgcttggaaatccttttcggtggtattttcaaaagggatgcccaagatatcaactggttgggtgggactttggttattcatagcagctcctttagactttgtttcatgcgaattgcaagattattttttgttaataatcggaaaaatgatagaatataaactaattatataacaaatctccggggaggatattgacacaatatgtcagaagacgataatttaacgctccataccgatttttatgagatcaacatgatggccacctactttgaaaagcatatggaaaatcgtaaggcggtttttgaagtgtttttccgcaagctgccgtttggcaacggctacgcggtatttgcaggcttggaacacattatttcatacatcgaaaatttacaattcactgatgatgatatcgattatttgcgggaagtgacagattatccggacagttttttagaatacttaagaaactttgaatttaaaggcaccatcaaatcagcctatgaaggcgatattgtttttgccaatgaaccaattctccaagttgaggggagcttgtgtgaatgtcagctggttgagacggccattttgaatatggtcaattatcaaacgctgattgcgaccaaggcttccagaattcggacggtggtcggtgacgatccgttgatggaatttggcacccgccgagcccaggaagtttccgcagccctttggggaacccgggcaaccatcattggcggttttaacgccacttccaacgtcttggctggtaagaagtttggtatcccaatcagcgggactcacgctcattcattggtggagtcgtttggtaatgattatgacgcttttaatgcctacgctcagacccatcacgactgcgtgttcctggtagatacctatgacaccttgaaaagtggggtgcccagtgctattcgggttgccaatgaaatgggtgacaagatcaattttgccggcgtcagactggattcgggcgacatggcttacctttccaaacgagtacgtgaagttctcgacaatgccggttatccgaataccaaaatctatgcttccaatgacttggacgagacgacaattgccagcttaaagatgcagcatgccaagattgacgtttggggtgtcggcaccaaagtcatcactgcctttgatcaaccagccttgggcgctgtttacaagatggtttccgttgaagacgctgacggcaaaatgacggatacaattaagatttccggtaatgctgagaaggtttcgacacccggcaaaaaacaggtttggcgcattactgacagtaaggatggtaagtcggaaggcgattacgtcacactggccgatgaagatccccgcaaagaaaagtcgatcttcatgttccatcccaactatacttacatcaataagactgtcgataattttgatgcaatgccactgcttaaaccaatttttcaagatggcaaattagtgtacgaccagccaaacttaaagcagattgtccactacgccgaaaaggaattggcatcattgtggcctgaatacaaacgggagttaaatccccagaagtatccagtcgatctgtcccaaaagtgttgggataacaagcgtgacatcatcgaaaagattcgcaattatattcaagatatcaactactaaatttgtaatcgagggatgcatatgcgagctaaacaacaagaaattattgacgcgttaaaagtgaaaccaacgattgatcccaaagccgagattcgtcgttctgttgactttttgaaagactatcttaaaaaattttctttcctaaaaacattggtcttgggcatctctggcggccaagactcaacgctggccggcaaattggctcaattagccatttccgagctccgggatgaaaccggcgatcctgactaccagttcattgcggtccgtttgccatatggcgttcaagccgatgagtctgatgccttggaagccatcaagtggatggacgctgatgttgtcgccagagttgacatcaagcctgctgttgacgccgcggtggcttcagttgaggcaaacgatctcgaagtcgctgattttaataagggtaatatcaaagcccgtcaacggatgatcgcccaatacgcaattgccggtgccaaatccggtgccgtggttgggaccgatcacgctgccgaagctgttaccggattttataccaaatttggtgacggggcagcggatatcacgccactttggcgtttggacaaagagcagggcaagcagctcttaaaattactcggtgcccccgagcatctttaccaaaaaacgccaactgccgatctggaagacaatcggccggcattacccgacgaagttgccctgggtgtgacgtatcaggatatcgacgcttatcttgaaggccgcgaagtttctgagaaggctgctgagaccattgagagctggtatgacaagacgcaacacaaacgtcacaccccgattaacgtttatgacacattttggaaatagatatttagtgacttttcattagtggttaggtataattaccataaataaagggagtaaccagcaatttcgattgcgattatctcgtcaacgtgaaatactcgtatttccgggataaatcttaaatggtgagacttatgaattcttttagcgaggaatttgtgggtctcttttcttttagaggaggaagtttatgacacaggagaagaagatgttctaccaacgaacagtcgatgatgtgatgagtcaaatgaaggcccatcccactggtctgtctgagcaggaggtcaaagaccgtcgggaacaatttggtgccaacagattaacgtcaaagcggcggaccacgttaatcgagaagttcatttcccaatttaaagatttgatgatcatcatcttgattattgcggcgattattgccgggtttgccggtgaaacggtggatgctgcgattattttggccgtggttatcctaaacgcggtgtttggggttttccaggaatccaaggccgaaaatgcgattgattcattaaaagaaatgtcggcccccatggcgaccgttctgcgaaataatcaaccgatgtcaattaagagtgaggacattgtcccaggagacattgtcctcttagaggcaggagatgtcgttccagccgatgttcgactgattgaggctaattcccttaagatcgaagaagcggccctcacaggcgaatctgtgccggttaacaaacaggtggacccaatcagggaagacgacctgccattgggagatcgaaaggatttgggcttcatgaacagtaacgtgacgtctggtcgggcaaccggcgtcgtgattggcacagggatgaatactgaagtcggcaaaattgcccatatgttaaacaccactgaagaaacgaccacgccgctgcaggagaacctgaaatcattaggtaagatgttaaccgttttgattctggtgattgctgtcatcgtgttcgctgtcgggatgtggcggggacaagagagcttgattaacatgctgctgacggcaatttccctggcagtcgcagccattccggaaggcctgccagcgattgtgaccgtgacgttggcattaggaacccagcaaatggcccgccaccgcgccttgattcgaaagctgccggctgttgaaacgttgggaagtaccgatgtcattgcctcagataagactggaactttaacccaaaacaaaatgacagtggaaaaagtcttcttgaatgaaaaaatgcaagattccgctgacacccatttaactttaaacgatcgattagcgcaaatcatggttttgaacaatgacaccaaatatcaagaaaatgagttggctggcgatccaaccgaaacagctctggtgtcgttttacttacatcaagaccagccagtccaaaagtttgtcaattcccatcggcgactggcagaaattccgtttgattctgagcggaaattgatgtctacctacaaccaaatggacaatggccaaatcctaatgaccatgaaaggggcaccggatcagctgttggaacgggtcaccaagattcaagatggggacggtgttcgagacatcactgacgatgacaaacggttaattagtgccaccaaccatgatttggcgactcaggcgctgcgggtgttggcgtttgcctaccgtcttgtagacacgataccaactgagctcacatcagccgcccaggagcacgatatgatctttgttggtctcatcggaatgatcgatcctgaacggcccgaagttgctcaagcagttgcggaagccaaatctgcaggaatcaaatcgattatgattaccggcgatcatcaagatactgcccaagcgatcgcgaaacggttgggaatcttgggtcggggtgacaatcctggcgggaaagtcatcaatggggctcagctcgatgagatgtccgacgaccaatttaaccgggaagtcgctgacatttccgtttacgcccgggttgcaccggagcataaggttcgaatcgtcaaagcctggcagaaacagggcaaggtggttgccatgaccggcgacggtgtcaatgacgcgccagcgttaaagaccgccgatatcggtgttggcatgggaattaccggaaccgaggtttccaaagaagcctctgacatggtgttggccgatgataactttgccacgatcgtaactgcggttaaggctggccgcaaggtgtttgccaacattcaaaagtcactccagtatctgctttccgccaacttgggggaagtcttgaccttgtttgtgatgacgatgatgggttggcagatcttggcgccggttcagattttgtggatcaacctggtaaccgatactttcccggcaattgccttaggcgttgagccggcagaacccggtattatgaaacgcaaacccaggggacgaacgtccaacttcttgtccggtgggatcatgagcaacatcttgtatcagggattttttgagggctttattaccctttgtgtttatgcatttgccatcaccaacccggttcatgcttcagatgcgttggctcatgcggatgctttgacgatggcctatgcaactctgggactcattcaattgttccatgcctttaactccaagaccatccatgagtcaatctttagaattggcatgtttaagaataaattctttaactgggcacttttgggatcggctgtgctgttgatcatgacgattgtcatcccaggattcaacgagatgttccacgtgactgagttgactgcttcacaatggctggtcgttgtcttcggtggctttatgatcgttgttgtttcagaagtagtaaaatacattcagagacacatttcccataaataaaattgaatggaggctgatattttgaaaccacaagatatgcagcgatatgcaaaaaccgtctcggacgtgattgatgagacgtcaaaaaatggtgaggatttaaacgctgattacgaaacactcagaaaggccattgataaccaaacggttgctgatttgaccagtgatcagctggcgggcattcaagcccattttcaatccggaaccgataagtaccaagataacgtgaacaagcttgagcaggtggctgtgccggttaaattgttaggcaagcacaagttgctggttcgtcattatgaggactatgccaacgcctgccaggcaatgacggacagtattgacccgcaggcttcaacggtggacgttgataagttcaaccaagctgagaaggatcaggaaaatagtatcgctaaggtttccagtacgactacgcggattatgggagaaatttaaagagtgcgaagcgggctgggtgacgcggtttctaagccaactttggtttgaaccccgggtttgggtttaaatcaaagctggcttagaggttagcgtcaggcccgcgaagcacgtttcaaccagagtgcgacaagcaacgttttgacacggagagctaaggtcgctttgattaaaatccggggtttggatttaaatcaaagaggcttagatcgtagtgtcagttgcgtcgaagcacgtttccccaaaccatctagaaacccactccacaacaggagttcccaaaattaaaaaattaacattcaacattcagcccaaactgcagacaagtgttcctgccagcagtttgggcttttatgtccctgagaaaaccttgttggagtccccggcatttgcttcattctgctataattaaacgtaacactattgatgaggtgggaatacatggacaacacattagcacataagattcagcaagacttacccaaaatccgggagaaacagatcgtcgaaaccctcaagatgttggatgaaggtgacaccgttccttttattgcccggtatcgaaaagaacggacttccaatctggatgaagttcaaattcgagacattcaagacgctgctcatcgcatccaaactttggacaagcgcaagcaggaagtcatcaaaattattgatgaacaaaaggccttaacccccgaactgaaaaagcagattgaggcggcctcggttcttcaacaagttgaagatctttatttgccctacaaacaaaaacggcggacgaaagcgacaattgccaaagaacatggtttggagcccttagccaaagccgccatgtcgtttgcccccgatttgaagcaactggctgcgcagtatgttcacccggacaaagaactgcctgatgttgacgcagtcttcgccggagtccacgaaattatcgctgaagacgctggcgaccgggccgattttcgcgaatgggtccgccaaaacacccaacgatacggtcagttggttgtcaaagttaaacgcggtggtaaagagttggacgaagagggcacctatcagcagtattacgatttcaatcaacccatcaaatcaattccttcgtttagaaccttggccattaaccggggtgaaaaagagaaagtgctttcggtcaaaattgaagtcaatgaggcaccaatcatgtggcatttaaaggccaacaccgtcggcagtcatcaaggatttgctgccgatgtggtcaccgatgcaatcgaagatgcctatcaccgcttcatcggaccggcaatcgagcgtgaaatccgcaagcagttgaccgaagtggccgctgatcacgccatcgatatctttggcaagaatttgtacaacttgctgatgcaggcgccactcaagggcaaaattgtcatgggatttgacccggcctatcgaaccggctgtaaattagcggtggtcgatcaaaatggcaagtatctggacaaaacggtaatctatccccataagcctgccagtgaagccaaacgtaaggctgccaaagggctgttcattgatttcatcaaccaaaatcacgttgaaatgatcgccatcggtaacggaaccgctagtcgggagtctgaacaatttgttgccgatgcaattaaagaaatcaaaacgcccatttattacgtaattgttaatgaggcaggggcgtcggtctattctgcaagtcaagtcgccagagacgaatttccggactttagtgttgaacagcgttcggctgtcagtattgcccgcagaatccaagatccccttgccgaattagttaaaattgatccccaggcaattggtgtcggtcaatatcaacacgatgttccgcagaaacaactgggtgaacagttggacacggtggttgaaaccgccgttaaccgggttggcgttaatttgaacactgccagtcccgatctgttggtccacatttccgggttgaccaaaacgaccagcggcaatatcgtcaaattcagaaatgaaaatggcgaatttagtgctcgctctgatctcaaacaagttccccggctcggcccgaaagcttttgagcaatcggtggggttcttgagaatcatcggcggcaaaaatccactggataacaccgatattcatccggaaagttattctgcggccaaaagcctcctgaaaaagcacggattgaccattaatcaactcggcgagccggccgtttcaactgctttgagtcagctcaatttggcccaggaagctgaaagcatcggagttggggttgcaaccttgaaagatattatcaagggcctcgaaacgcctggccgtgacttgcgtgacgaaatgcctgcaccgttgcttcgaaaagacgttttgacaatggaagatttgaagccggggatgaaactgcagggaactgtcagaaacgtggttgactttggtgtctttgttgatattggcgttaagcaggacggtttggtccacatttccaaaatgagtcggacattcgtcaaggatcccagcaaggtggcttcggtcggcgacatcgtgacggtttggattgactcagtggatctggatcgtcaccggattcaattaaccatggtggatcctgaaggttaggtgaacaaagaactcatgactgatcaagaactacagcaactcgttgaacatatttcgctgcaatactttgccaaaccgtttacccaccgggcctattttaatgcccgtttaaagacgactggcggccgttaccacctcaatgaccataacatcgacattaatccaaaaatggacgagggggctgatcatgcggtattaattgggattatcaaacacgagctgtgccattatcatctccatttggcaggatacagcgccaaacacaataccaagcagtttaaacagctgttaaaagcggtcggcggctccagatacgctcccagagtccagagtaccagggtccaaacgcgttatatttatcgctgtgaagactgcggtttggagtatcatagaagacgaagaatcaatctggtgaagtatgtctgcggcagatgtcgcggtaagcttcatttaatcagccaaacgcggcaaatcggagcgtagaaaggagccatcacatggcaaaaattattatcagagtacctgcaacgaccactaacctcgggtcgggtgttgattcggttgggttggcactgcagctgtattacacggtgattgttgaggaaaagacagatgaatggaaggtcaaccatgctttgggacacgacattccaactgatgagcacaacctcattgttcagacaatcttaaaggtcgattctgatattcatccgcatcaactgaccgttatctcggatgttccgattgcgcacggtttgggctccagcacaaccgcagtggttgccgggattaaaattgccaacaagttaggggatttggggctttcaattgaagatcaaattaatttgggaacaaagattgaaggccacccggaaagcgttgctgctgcgatgcttggcaacttggttgtttcgacatatgacggtgaaaccgtcactgctgcgactcttcctgtaccagacgtctcggccttaatgtatattcgaccggatggtgtcagcgaggtagaaagtcgcaagaagctgccgaaacaaatcgattatgacgtggccgtccatgccagcagccaggagaatgttttcatcgccttggtcgcccagggcaaatgggagcaggcggttaagctgattgagaatgatcatctccacgagccctacagaaaagagctggtcccagaaattgatcaaatccgttcaactgcccacaagttagacatctttggtacttacttgagtggtgccggtcctacggttgccacactgggtaagaaagctgctttaacccagctaagaattgatttggaacaacaaaatctaaatggtagtttgcggctgctgcaaattgatacagaaggcgcgaccgttcgcggtgaataattttcaaaaaccatttgtcaattgccaaaatttctgctataatttttaattgttgatgcggccatggcggaattggcagacgcgcaagattaaggatcttgtcgggaattatcccggtggaagttcgaatcttcttggccgcatggttaaagttcgaatcactatcatctcaatagtgattcggacttttttattgtgtagcatgtgatattttgctcaaataataagcgattggagtacaggaatgaaatattttatttttgatgtagacggaaccttgattgataccgaaaagatgtatatgttaccactacataagacgctgctggaaaacggctatgacttctcttatgaagacgtcgttaagctctttgggattacctccatggatacggttcgaattcttggtgtcaagaatccggttgacattcgggaccaatggtttgccaaaattaaagattacacccaatatgcccacgtttatgatgggattgaggatgtggttaagaaactgcatgctgatccgactatcaaaaccgcgattgccacttccaaggttgaagccgaatttcaccgggatgtcacaaaatttggactggatcaacactttgatgcctttgttttttccaacgaaattaaaaaaggcaagcccgctcctgacatgattttaaagggcattgagaaattagacgctgatccggcaaccaccatttatattggcgataccaaatttgatctccaagctgctcacgctgccaacgtgcagtttgccctggccggttggcggaccaagaaaaccgcggactttgcggacacggattacgatttaaagacgcccgcagacttactaacgattcagtaattccggcaaacgaaattgctattttgtgatatatttggtgtaaacagactttgttaaatttaagaaatgggtgagtagatgatttcaattctggttgtgagccacggcgattttgccaaaagcttagtgacgaccgcagaaatgattgccggcaaacaggaacaggttggttgggtaagtctggccgcaaatgatggggtggattcacttagtgataaggtcgcttctgcattggctgactttcctgagggtacgccaacgttgattttggcagacttgtggggtgggtcgccgtttaatgccgccgcccaatttgcagccaagaatccgcaatcgattgcattagttgccggagtcaaccttccgattctgttggaggcctacatggcccgaaattcaaccctgagtgaattagttaataagatcaatgagattgctgacgattcgattcgtcagtttgaagtttctactgataatgatgacgatttgggagatgatttataatgacaatggatattcgccttgcgagagtcgacagccgcctgctgcacggccaagtggcaactttttggacacgggcggtgacgccgaaccggattatggtggtctctgattctgttgccaaagatcctttgcggaaaacattgattacccaggtggcaccacctggtgtcaaagccaatgtcgtcagcgttaacaagatgatccgagcctatttcgactccaggtttgattccttcaacacgttgttgttgaccgaaacagtggctgacatgttgaaattagcagagggcggcatcgatttttccaagattggcatcaatatcggcagcattgcctataacgacggaatgacgatgcttaccgatgccatttcgatgaatggagatattgccaaagaaattcgaacattggcaaatgactttcatctagatgtctatgctcaaaaaattcctgctgagaaaaaggaaaatttgttgaccctgttggataaaaagggcttttaaggaaccgaggggaattcaatgagcttagtttcaatcagcctggttttgttggttgcatttgtggtcggaatggatggcattcttgacgaatggcaggtgtaccagccaatgattgcttgtacgctgatcggtttggcaactggcaacgtcggcgttggcattatgctgggcgcaattttacagatgatcacgattggctggatcaatattggtgcttctgttgcaccggatatcgcgctgccggcagtcgtctcggctcttttagtgtgcggtccggccgccttaagtattaaacacgggattgccttagccgttccctttgcggttgttggccaacttttgaacgtcaccatccgtaaatcaattgtcaaatttatccatacggccgaccaagctgccgaaaatggtcaaatccagcagattgatcgcattcatctgctgagtttgggaattcaagggctgagagtcctgattccgacgggactcgtgatgctgatatctcctcaattcattcatcagttaatgcagcaaattccagcggggatcacgaatggcattgccatctcaattggcatggtgtcggccgttggatttgccaacctgattaacatgatggtcagccgctctttatggatttggtttatcgttggttttttaattgccatttttacgaagatgaatctttttattttagcaggattaggcttggttgcagccatcagctttgtttggcttaagagtagacggcatggctcaaccggcggcgatggggaagggaaagacgatttagatgactttgacaaagaacttgatgatttataggagttggtgggtataaatggcaaataatcaaaacatgattcacgattcccatcaaccgattcatcttcgtcagatcgattttttccggaccttttggcgctctggcacagagcagggatcgtggaactttgaacggatgcaaaacctcggatttgcttatataatggctcctgcgattaaacgattgtatccggatatgaaccaacgtaaagctgcgttgaagcgccatttgggcttttttaacaccgcaccaattatgcagtccctgattactggagtggttttgtcaatggaagaacagcgggcaaatggtgccgatattagtgatgacacgattaatgccgttaagactgctatgatggggccaatgggtggttttggtgatccggtttggttaggcacgatccgtccggttctatcggcatttgctgccagtctggttttgagtggctatggcatgatgggaccaattctattttttattgcatggaacgttttacggctggtctttcgttatatgactcaaatggccggttatcgtcggggagccgatattattaacttgtttaataccgggattattaagtacgttgggagtgccacttcaatgtttggcgtctttatgatgggcgtgattgttgctcggtgggtcaccgttgattttgcatcagttcggggactctttggcagttcaacgacttcccggtttgtggacacgatgattaatggcggccttaacgtgattgctccggttgccttgaccctgatttgtgtctggctgatccgcaggcgaatttcgccaatctggattattctggggttgttcgttatcggagttcttggctactatgccggggtattggtttaaaaagcaaaagttacataaaattgattgtgaaaaaatagcggctcagataaaagttggtttgcttttatattgaaagatatctagcaaaaccaacaaaataataattttaatgagatacgttcctgaaagctgctgaagctccattgagaaaaacgccatcgtgataataatgccaatctgacaagtcacaatgatttttttgtggctaaaacgatccacaattgttccagaaacaggcaataaaactaatgatactaaggggccaatcaaaatagaaattcccagattcatagcagatcccgttttacgtaagagaaataatcccaatgcgaagctaaacatgctgcttcctaactcatcaattaatgcaataataccgactttaacaagttgtgctttactagtattcagaaaatctttaataataattccttctatcgttaaaatttatttttgtgataacttagttatattccagttatttagaaatgttaataaaatatattttaacgataaaataaatattattgtaaaaaaagccgttttaatatctctattaaaacagctcttatttgtaaattatttaacttttgcaatacgtccttgttcaatataaacacttaaaatagcgatatcagctgggttaaccccactaattcgactagcctgtgcaatcgtttctggttgaattttctccaacttttgacgaccctcagtagccaaaccattgatcgcagcgtaatcaatgtgatccggaatcttcttagcttccatctttttcaaacgttcaacacgttctttagctttcttgatataacctgcatatttaatttcaatttcaacttgctcaaccacgcgccgatctaacttcttatccggcgcagggataaattgcagcaagtctttgtaggaaacctctggacgacggagaaattctgatgctaaaacaccatcttttaattcatgaccacccttagaaatcaagaaatctttaacttgtttaggttttatgcgaatggtatctaaacgatgaagttcatttttaatatcatcttttttctcttggaattgttggtaacgatcgttatcaatcaaaccaaggtcatgacccatctcagttaaacgcaaatccgcattgtcatgacgtaaaatcaaacgatattcagcacgactagtcagcaaacgatatggttctttggttcccttagtcaccaagtcatcaatcataacaccaatgtaagcatcactacgttttaaggtaaactgacctttgtctaaggcacgcaatccagcgttaattccagccatcaaaccttggccagctgcttcttcataaccggacgtcccgtttgtttgaccagcggtatacaagtttttcacaactttagtttctaaagttggcttcaattgatagggggaaaccacatcgtattcgatagcataaccaggccgcatcatttcagcatcttctaagcccttaatggaatgaagaatttgttgttgaacctcttctggcatagaagttgaaagtccctgaacataccattcatctgtattccgaccttcaggttcaaggaataattgatgatgatccttatccgcaaatcggacaatcttatcttcaattgaaggacaatagcggggaccaacaccttcaatcaaaccagaaaacataggtgcacgatctagattttttcgaataattttatgggtatactcattagtatacgtcaaccagcaagataactgatttttcacatcaatataggcactgtcaggcgttgtaaaactaaagtgatttggttccttatcaccgggctgttcttcagtttcatcataatgaattgtgccaccatcaactcgtggtggcgttcctgttttgaaacgttccaaatcgaaaccgtaatcctttaggttcttagtaagtttcatggcaggttgtgagttattagggcccgaagaatacataagctcgccgataataatcttcccacgagcagctgttcccaacgtcagaacaacactcttggcatggtaacgagcaccagtattagtaattattcccttacagacaccgtcttcaatgattaaatcatcaacaattccctgtcgtaaagtcaaattaggttcatcttcaatagtttttttcatttgagcatgataagcatgtttatctgcttgggcccgtaaggcacgaactgcggggcctttacccgtatttagcattcgcatttggacataagttttatcgatgtttttacccatctcgccaccaagagcatcaatttcacgaaccacaatgccttttgctggtccaccaactgaaggattacatggcataaaagccaccatatccaaattgatagtcattagtagggttttgtttcccattcttgcagctgccaaagccgcttctgaacccgcatggccggcgccaactacgatcacatcgtaatctttccctgcatactgttttacttccgtcatgactcttcctccacattatttcgagcttcaagtagcttcataatttgtttcatggttaacttaattgaacttcaattatttacccaaacagaattggctgaacaactgatctaataactcatcttgataactgtcaccagtaatttcaccaagaaattcccagcaacgcgtcatatcaatttggactagatctactggcataccatctttgagcccttgcaaaactgaatccaatgcttcttcagcttgattcagcaagccaatatgccgagcatttgtcacaatgacactgttttgattactttcaatcccaccgaagaataacttagaaattttttctttcaaatcatccaatcctaccccttctgttgcagaggttcgaatcacctgatcctcaggaactaaattgaataattcatcagtatctaattgcattggtaaatcagttttattcaagataatgattcgttttgcttcatcagtgactttaattaactgacgatcttcatccgacaatggattactactgtctaaaactaacaagaccaagtctgcagttttaattgctttacgactgcgttcaacaccgattttctcaactttatcgtttgtttcacggataccagctgtatcaactaacttcaacggcacaccacgaacattcacatactcttccaaaacatcacgcgtggttccagccacatctgtgacaatcgctttgtcttcatgtagcattcgattcagcaaactagacttcccaacatttgggtgccccacaatcgccgttgccagtccatcacgtaaaattttaccttcttgcgcagtttgcaaaagttgtttgatttgtgctttcacttctacagctttttcacgtaatagtttactggtcatggtctcaacatcatcatattctggataatcaatgttaacttcaacctgtgccaaaacgtctaaaatatcctgccgcaaattcttaattaaatgagataaatccccatctaattgatttaaagctactttcatcgaccgatccgttttagcacgaatcaaatccatcactgcttcagcctgagaaagatcaactcgaccgttcaaaaaagcacgttcagtaaattcgcctggtttggccattcttgcaccgttacttagtagaagctgtaaaatatcgttggtaggcacaatgcctccgtgacaattgatctcaacaacatcttcacaagtatatgttttgggtgccaacatcactgaaaccattacttcatcaactgtgtgctttgttttagggttaacgatatgcccataattaatggtatggcttttaactgtatgcagatccttacctttgaaaatcttctctgccacatcaagcgcggtatttccacttactcgaacaatggaaataccaccttcaccaggtggggttgaaattgcagcaatcgtatctaattccgtagctgtttctagcattttctatttccttcctaatcaattccaataaaaaaagcacctagtccacgccttaataagaggttacgtggataaagtactttcactactttacctgctatttagataattgattatatcttaaaattttgttgcgcatttgtcaatttcttacacttttattttaaagctgttcatcttgaacaagggccaccacaacatagcgatgaggttcatgtccttctgaaaaagttgagacaaaatgattctcagacagcgtcgcatgaatcacttttcgctcaaatgcgggcatgggatccaagaaaactggttcaccagttgccacaacctcacgagctgtattttcggccaagtgttgcaacgtttctgtccgtcgttcacggtaattttcaacattcaattttacattggcatgtgaaatgccgcgatgtagcaaaaatacttgagctaaagtttgtagtgcgttaattgttcgaccatgcttcccaattagcatgccctcttgctcagttctgaactctattgaaacgtcacgatgatgaaatttacttgttgaagtagcttcaattcccaactgggtcacaatctttgccaaatattcctgcatttgagaaacaatttcttcattcaaacgcggacgcgatgaggtttctggttctatagcttgatccttgacttgcgggtgcctttgaacttcagctttactttcatgatttacttcatcagttttatgttgaacttcagaattaacttttggtttagtttctggcgctttttcttcaggaactttgaccgtctcgtttgattttggagcctcaataactgacatttcaatttcagccaatcgtttgccgaaacccaaaaatccttttttaggttcgactattgttgaaacagttacacttttacgggttacatttaaatcagcaagtcctgcttcaattgcttcttcaattgtactccctttataatttgccataggctacctcctttttacgattatgtacagcaaaaggagaccagaactaaacattctaatctccagtcatttttattttctattgcgtcctttataagccttacgcttagcttttgcaatggcccgttttttatcgcgttcagcctgtgcttttgcttcacgttcacgattaatcttaaacggattttgaataactaatgtttgaccagcttggaaaatatttgtaaccacccagtacagggaaacagctgatggcacacttaacgctgtaaagaagataatgaccggcataccaatggtcatcattgttgtcatcccattttgcattggttgcgacttcatactcagccatgaactcacataggtaaatacagcagctaagataggtaatacgaagtacggatccttgtctcccaattgcagccataaaaatgatcctgccttcaaaacttccgtccggttaacagcggcatacaaagcatacaaaacaggtaactgaacaattaatggtaaacacccagcaacgggatttacaccagcttcggaataaagtttttgttgttcttcacgcaatttttgctgtgtttcagtatccttagaggaatacttcttttgtaaagcttgaaccttaggctgaatttcagcagttttcattgaagattttgtttgataaatcatcaagggcaagatgataatacgaataataatggtgaaaataataattccccaaccaaaattaccaccgaataaatgtgataaccaaataattgcccgtgaaaaattatagacaatccaatgatcccaaaatccggtactattcttcgtgataggtgccgtactacaaccagctaaaaacagcgttaaactggcaattgccatcatcactatatttcttttgctgtgtttcacttacttttcctcactttgatcagtagttaaaatattagctaacgtgaatacgtgctttaattgctgtttggtctctttcattgaaagaccagacgcttggggccgtgcaatgaccaaaaagtcaatatcttgacgtagttgtggtttgaattcaagaacgctttgactgatgcgtcgcttcatatagtttcgcataacagcattaccaattttcttaccaacagaaattcccacccgaaaatgaggttgatgtggtttctccatcacataaacaacaaactttcgatttgcatatgaattatgagtttcaaataccttttgaaattccgtttctctttttacacggtatgacttgcgcatgctctctctccaaaataaatcgtattatcaagtttctcacatataaaaggttgtttgtctgctattttcaaatttcttcaaaaataaaagaccactgggatcagtggccttatgcagataattttcttctaccttttagacgtcgacgtgctaaaactctacggccgttacttgtactcatacgtttacgaaaaccatgcacacgtgaacgatgacgcttctttggttgatatgttcttttcaattcgtacacctcccatagcaacactgaaatttatatagatttcatttatatattaatgaaataactcagtatctaattacaattaccataatatagtatcacaaatcaatcatcatgcaaaggtcttaatagaaaaaaataaatattcttgttcacactcaaagcttatcgtggtgcataccttgtggataaaaacatttgttttcctaagttttgcacagtttttcccgagcttatccggatattcaccccctgtgattgagttatccacatttccatgattttcagtggataactcctgccaccccttatttctcggggtatagttatccaccgttttgtgtgaataaccaaaattttcatgaaaatttggccttttttcaacagcttgtggatacacttttacctgtcctgtgatttattttcgatagttttccacatcctgtggaaaacttttttttttcatgctaaaattaatgcattgtttctttcgcttaagaattgaaaacacaaaaaataaactgtgcgtaactttggagggatttttgtgctaagtaaggatgatctttggaatcaaattaaagctgattttcaaaaagacgatgatatttcatccctcggcttttcaacttggatcgacgtagctaaaccaatcgatctaaaaaatcatatcatgacaatccaattaccatcgccgttacatcgcgattattggaaacaacatttggcaccaaaatttgtagaatatgcttatttgatcacccaagcagatatcacaccagattttgttttggagggtgagcaagaagaaaccgttcaacaagaaaaaaaggctgccgaaaaaccaaaaacgacacccgattttatggaagttactaccttaaatgacaaatatacatttgacacatttgtcactggtaaaggaaaccagatggcccatgcagccgcgttagtcgtttcggaagatcctgggactatgtacaatccgctcttcttttatggaggcgttggtcttggaaaaacccatttgatgcatgcgattggccatcaaattctcaaaaataatcctgatacgaatgttaaatatgttactagtgaagctttcacaaacgattttatcaatgcaattcaatctaaacatcaagaagaatttcgtgaggtttatcgaaatgttgacctgcttttagtcgatgatgtgcagttctttgctgataaggaagctactcaagaagaattcttccatactttcgaggctttatatagtaatcaaaaacaaattgtgctgacttcagatcgtttaccaaatgaaattcctaagttgcaggaacgactagtttcgcgctttaaatggggattatcggtcgatatcaccccacctgatttggaaacgcgaattgccattttacgtgaaaaagcgatggctgataaaattgaaattcctgacgatactttgaattacatcgccacccaagttgattcaaacgtacgagaattagagggtgctttagcgcgggttcaagcatatgcgaatctgcaaagtactagcattacaactgatcttgcctccgaagccatgcgtagtttgaactttggtactaaatttagtgaagtctcaatttcgctaattcaagacaaagtcgctaaatactatcacacttcaatttctgatttaaagggtaagaaacgaatgaaatcaatcgttgtccctcgccagattgctatgtatctttctcgcgagctgacaaacgcctccttaccgaaaatcggaactgaatttggtggcaaagatcacaccactgtgattcatgctcacgaaaaaattgcagcggcgcttaaaaaagatgatgatttacaacgccaaattggtgatctaaaaagtgagctcaaaccatagcttgtggacaagtgtgaattactttaaaagttatccacattttataaacagagataatcttcgacctgcctaagcgttaggtgacatttacacaatatcaacaggccctattactactgttacttttaatatataattatatataaatacatttcgtccaaaggagattcttaaaaatgaaatttactgtaaaacgagctgcgttcattaaaaaattaaatgacgttcaaagagcaatatcttctaaaacaacaattcctattttgactggtttaaaacttgatgtggaatctgatcaaattatcttaactgggagtgatgcagatatttccattgagacagttttagatgccaaaaatgaagacaacggattgtcaattacagatcctgggaaaattgttttacctgcgcacttctttagtgatatcgttaaacgacttccagaagattcaatgaccgttgaaattactgaaggcttccaaacagagatttcatctggggccgcagaatttacaattaacggtttggatgctaataattacccacatttaccagaacttgacggtaatgaccaaatccaactttccggaaacgtatttaaacaattaattagccaaactgttttggccgtttcaactcaagaaagtcgtccaattttaactggggttcatttcagtattgatggcgaccaatttttagcagttgcaactgatagtcaccggttaagtcaacgccaaattaaattgcctgaaggaaatactggaaaatatgatgtgatcatccctggaaaaagtctcgttgagttatctcggatgattggcgaagaaaatccagacgtcatcacgcgaatttctgaaaatcaggttctctttactttaggtgacacagcgttttattctcgattacttgaaggaaattatccagatacatcccgtttgattccaaaagaatcaaccacaactttagaattcaatgcgccagctttattagcagccattgaacgggcttccttgttatcccatgaaagtcgtaataatgttgttaaattggcgattaccactgctgataaaaagattgttatttcaggaaactcgcctgatgtcggaaacgttgaggaacaacttgatgcaaaagttgttgagggcgaagatttagaaatttcatttaacccagattatatgaaggatgcgctccgttcgtttggccaaactgaaattcaagtttcattcacttcagcattgcgaccattcactttggttccaactgaggatcaagaaaactttattcagttgattacacctgttcgaacattctaaaatttaaaaaaataaccacgtttgccaaattaaattttgacaagcgtggtttttattttatgcctagaaattaaaataagaggatttgagaaaaatacgcaagaaatgtcaaaagtatctaattatcttcaaaatggcttaaaacgcaaaacacagcctctgagattgtttttttaggtttttaaaggtataataaataggtatttagtaaagaatctagttaaaattgaataaattattttttggtttaaaaaaacgaaattaaataataattgattcgaaataagttctagtaaaggtggttgtaattttggagaaaaaagaagttttaattacaacgccattcattacgctcggtcaactcttaaaagaagaatcaatcattggaactggcggacaagccaaatggtatcttcgcgaacacactatagaggtaaatgatgagcctgagaatcggcgcggaaaaaagctatatccaaaggacacggttaatattccagatgaaggactgtttattgtacgttcaagacgtgaggattagtcatgtatttggaaaatattagcctccataatttccgtaactatccggatttggaggccgaatttattcctggtgtcaatgtgttattgggtgcaaatgctcagggaaaaacaaatttgttggaatcaatttacgtgttggccctaacgagaagtcaccgaacatctaatgatcaggatttaattagttggggcgctgattcagctcgtttggcaacccgcgtacacaaaagaatgagttcaattcccttagaactggaattaagttctaaaggtaaacaggccaaggtgaatcatttagaacaaagtaagttgtcacagtatataggacaactaaatgtcattttgtttgcaccagaggatttgtctttggttaagggttcaccggctgttagacggcggtttattgacatggaatttggccagatgagtagtaaatatctgtataattccgcgcagtatcgcacaattctgaagcaacgaaatcagtatttaaaacagctaaagttcaaagtgaacaaagataaagtttttcttggtgtgttgtctgatcagcttgcagcttatggtgcggagattatatttcagcgccgcctttttctaaaaaaactagagaaatgggctcaacagttgcatacccaaatttccctaggaaaagaacatttgacgtttgagtatgtgtcacaagttatccagaaacaagatttatccgtagatcaactatatgacgagttgagaaaggcgtttgcgagtcatgaggaacgggagttgcagcagggaaccacattggtcggtccccaacgcgatgacgttcgttttttagtcaatggcaaaaatgtccaaactttcggatcacaaggacaacagcgaacgacagctttaagtgtgaaattggcagagattgatctcatgaaagaagaaacaggcgagtatccggtattgctactagatgatgtgttatccgaactagatgatgaccggcaaacgcaccttttaaagtcgattcaaaataaggtccaaacctttttgacaacaactagtttgagcggtattgctcgtcaattaattgatgaaccgcggatatttacaattaaatcaggtattttgcataaggaggaataagattggctgacgaagataaaacgaaaaaaactccccaagaaattgagacagcacgtgagcgtaaagaagaaaaagcagaagaatacgatgcaagtcaaattcaagttcttgaaggactagaagcagttcggaaacggcctggaatgtacattggttcaaccagtgcacaaggtcttcaccatcttgtgtgggaaattattgataacgggattgatgaagctttagcgggctttgcgaataaaatcaacgtgattgttgaaaaagataacagtattaccgtgactgataatggccgtggaatcccagtcggaattcaagctaagaccggtaaaccagccttggaaacagtttttacaatcttacatgctggtggtaaattcggtggcggcggatataaagtctctggtggacttcatggtgtgggtgcctcagttgttaatgcgttatcaactgaattggatgtccgaaccatgcacgatgataaagtctattatatggattttacacgcggtaaagtgaagactgccatgacggttattggggattcgaagccccacgaacatggaactatcgtgcatttcttaccagatgcagatattttccaagaaaccacaatctttgatattaaaactttacggacacgaattcgtgaactggcattcttgaataaaggattacggatcacgttaaaagatatgcgtcctgaaaagcctacggaagatgatttcttatacgaaggcggaattcgccactatgttgactatctcaacgaaggtaaagatgttcttttccccgacccaatctatgttgaaggggtggaaaaaggcattacagttgaagtcgcaatgcaatatacagagggttatcaaagtaaactcttgacctttaccaacaacattcatacgtatgaaggtgggactcatgaagaaggctttaaacgggctttaacacgggttgttaatgattatgcgcataagagtggcatgttaaaggacaatgaggataatctttctggtgatgatgtgcgggaaggtttaacagccgttgtcagtgtaaagcatcctgatcctcaatttgagggtcagacgaaaactaaattgggtaattctgatgccaggaccgccgttaatgatgtatttggggaacatttcaataagtttttgatggaaaaccctgatactgctcggaaagtgattgacaaaggtttattggcatcaaaagcccgaattgctgctaaacgagcacgtgaagtgacccggaaaaagagtggtctcgaaattaataatttgcctggaaaattggccgataatacgtccaaagatccatcaattagtgaattattcattgtcgagggtgattctgccggtggtagtgctaagcaaggacgttcccgtttaacgcaggccattttgccaattcgaggtaaaattttaaacgttgaaaaagcaactttagatcgtgttttggctaatgaagaaattcggtcactgtttacagcccttggaactggttttggtgaagaatttgatgtcacgaaggctaattatcataaattaattattatgaccgatgccgatgtcgatggtgcgcatattcgaacattattgttgaccctattttatcgttacatgcgaccaatgattgataagggctatgtttatattgcccagccacctctatatcaagttcgtcagggtaaaatgattcgttatattgattctgatgaagaattgcaagaagttttgggacagttgccaccaagtccgaaaccagcaattcaacgatacaaaggtttaggtgaaatggatgcttctcaattatgggaaacgactatgaatcctgataatcgtcgtttgttacgagtatctgctgaagatgctgatgcagccagtggggattttgaaatgttgatgggcgatcgtgtagaaccccgtcggaaattcattgaagacaatgctgtcttcgttgaaaacttagatgtttaatttaggattggaggttaactaatttgtctgatgaagaaaatattgggactcgagtaacggatgtcaatttgagtcgagaaatgcgaacatccttcctagattacgcgatgagtgttattgtggcacgagctttgcctgatgtgcgtgatggtttaaaaccagttcatcgtcgtattttatatggaatgagtgaactgggtgtgaccccagaaaagccatataaaaaatcagccagaattgttggggatgtcatgggtaagtatcatcctcatggtgactccgcaatttatgaatccatggtgcgaatggcgcaagatttcagttaccgttacatgttagttgatggtcatggtaactttggttctgttgatggtgatggggctgccgcaatgcggtataccgaagctcgaatgagtaagattgccgttgaaatgctgcgcgatattaataaaaataccgttgattttcaagataattatgatggcacagagcgcgaaccaaaagtgttaccagctcgttttcctaatttacttgtcaacggtgcaaccggaattgcagttgggatgaccactaatattccgccacataatttggccgaagtgattagcgcaattcatattttgatggataatccggaagcaaccactgctgatttgatggaggctgtacctggacctgacttcccaaccggtggtgtggttatgggtaaatcaggaattcgtaaagcttacgaaacgggtaagggaaccattattattcgggctaaagttgatattgaacaggaaaagagtggccgtgaaaaaatcgtgcttactgaacttccttacatggtcaacaaggctaagttaattgaacgaattgctgaattagctcgtgacaaacgaatcgaaggaatcacagacgtaaacgatgaaactgaccgtgaaggtatgcgggttgtgattgatattcgtcgtgatatgagtgcttcagttgttttgaacaatttgtacaaaatgactttgatgcagacaacatttagttttaacatgttggccattgtggatggggcgccaaaagtgcttagcttaaagcaaattttgacctactatttaaagcatcaagaagaagttattcgccgacggactgagtttgatttaaagaaagctcaagcgcgagctcatattcttgaagggttacgaattgcgctagatcacattgatgaaatcatttcgattattcgtaattccgaaactgccgagattgccaaagatcagttgatgagtaactactcattatctgacaaacaatcgcaagctatcttggatatgcgtttggttcgtttaacgggcttggaacgtgaaaaagttgaaaatgaatacaccaaattaatgactgatattgctgattataaagatattttggctcatacagagcggattaatcagattatttatcaggaattacttgatattcaggataagtttggtgataaacgccgaaccgagttacttgttggtgaagtgcttagtcttgaagatgaagatttgattgaagaagaagatgtcatgataaccttgactcataatgggtatgttaaacggatgccacagtctgagtttaaatctcaacgtcgtggtggtcgtggtgttcaaggaatgggtgtgcatgatgatgatttcattgagcatctggtttctagttctacccatgatgtgttgttattcttcacaaatgccggcaaagtataccgcatgaaggggtatgaaatccctgaatacgggcgaacagctaaaggtattccggtcattaacttgttaggaattagtgcgggtgaaagtattcaggccgtgatcaatgctggtcagaatcacgaacaagaaacggagcgttatctgttctttactacactaaagggtgttgtcaaacggacccccctaaacgagttcttgaacattcgaagtaatggcttaaaagcgattaatttgaaggatgatgatgagttaattaacgtggttatcacgaataataaacaaaacatcattatcggaacacatagaggttatgcagttagttttgcagaaactacagttcgttccatgggtcgttcagcaactggtgttcgtggtattcgtttacgagatgaagactatgtggttggggttgatctattgcaaccagaaagcaaagttctcgtcattactgaaaaaggatatggtaaacgaacattagctagtgagtatccaatcaagggtcgtggcggtaaaggtattaaaactgcgaatgtcacaacgaagaacggaccattaactggcttgaccaccgtaactggtgaagaggatatcatgttgattaccgatcgtggcgtcatgattcgttttgccgttgattctgtcccagaaacgggtcgagcaaccatgggggttcatttaattaaaattgatgaggactcaaaggttgccacaatggctaaagtagatcatgaagacgatgaagaacctgatgattcaacacaatcttcaacgaccgacaccactgagcaagctccagaagaaagttcatctgaaaattcttcagaagaataattaaattaataaaataaatcccaataaacgacgtaacttagttatgtatcgttttattgggatttttgtttattgcgttgcataagtataaatgctataatttaagttcgtgagtaactattaatttagaagctctccttgctttcttaaattgttaaggaagccacttagtccataaggaggtgtaaaacacatggaacaaaaatcatacgaaattacttatatcattgctccagatgttgacgaaacagctaaggctgccttagtagaacgttttgacaagatcttgactgacaatggtgcagaagtggttgattcaaaagattggtccaagcgtcgttttgcttatgagatcggtggatacaatgaaggtatctatcatgtcgtaaatgtaaaaacaagcgatgacaaagctttaaacgaatttgaccgtatttcaaagattactgacggtatcttacgtcacatgatcgttgtacgttaaaaataaacagaaataataattcagaaaggagtcattgtttatgataaaccgaacagttcttgttggacgcttaaccagagatcccgatttacgatacaccaacagcggtgctgcagtcgctaccttcacagtggcagttaatcgtcagtttacgaacgctcaaggagagcgtgaagctgattttattaactgtgtgatttggcgaaaagctgcagagaacttctctaattttacccataaaggctcgttggttggagtagatggacggattcaaacccgttcgtacgaaaatcaacaaggcgtccgagtatatgttacagaagttgttgttgaaaacttttcattgttggaatcccgtgctcaatctgagcaacgtcaacagcaaggtggcaatacgggatttcacgacaatgctcctcaatcatccggtaatagcaatccgtttgatgctgggcaaggaagtaacactaacagcaataacagtcagagcagtagcaatggcagtgcttctagtgcaagttctaatcctaacgatccgtttgcagataacggcgaacaaattgatatttccgatgatgatttaccattttaatcattagaggagggattttcaatggctcaacaaagaagaggcggaaatcgtcgtcgtcgtaaagtcgacttcatcgctgctaaccatatcgaatacatcgattataaagacacagatttactgaaacgattcatttcagaacgaggcaaggttttgccacgtcgtgttaccggaacaagtgctaagaaccaacgtcgtttaacaattgcaattaaacgcgcacggatcatgggcttacttccattcgtttcagaagaataattaattcagacttttcaaatcaatagtgatttggaaggtcttttttaatcgtttgaaaatgggcaaactagcagcattatttagattgagatagtacagaagtgtataataacaacgtcacagcttattaaggagtttccgtatctataaagggattagttagtgacaggccactcaaaattataccaactttttatacaaaaatgctttataataatagatagttaatacataaaaaaggggaacatgaatgtatcggtattttattcaaccacaactaaataaggtgaataactcgcttattgggtatgaattactgatcagacggcggactactgatggttggcgaccgcctaagcatttttccgatattccggtttcaattatcgcggagatgttgacggcagctaccagtagactagtgtttaaaatcgggtcagtatctgtcaatttgaatcgcacacaaatgatggatcccaaaatcaatgcggctctaattcgctcgcaagatcagttacgtcccttaaaattaaatgtggaactcactgaagaacctggggatgaatccattacaaatgctgatttgaaaccgatgttacagcgatttattcaacgggggatggaactttgtctcgatgatgttggaactggtgataatcagtatgaagaaattcaagagttgatcccatatgtgagtgaactcaaatttgcactccagaactttgagcaaagtttccaagatgcagcgattcaagcaaaagttatttactggcgggatattgctaaaaaggaaaatttacggttcattcttgaaggaatcgaagataaggctgatgatcaactagccgataaattaaatattgatttgcgacagggctattattatggcaaaccttatttacttaaagttaaaccagatgatccagactaagtaaattttttggggaagaaggacattattatgaaagtcgttattgttggttgtacgcatgctggtattgcagcggcaacagaaatttttaaagcacatccggatacagaggtgactatttatgagaggaacgataatgtctcttttttttcatgtgggatttctttatatttgaatggccaagttaaacgacttgaagatatgttttacgcaacaccagaagatcttgctaaacaaggagctaaagttcgcattagacatgatgtgctaagcattgacactaaaacgcatcaacttatcgttgaaaatctggataataaaaaggtttttacagataattatgacaaattgattatgtcaaccggttcgtatgttgtggtgccaccattgatgggaattgatgattcgcatgttttactctgtaaaagctatgaacaagctaaacaaatttatacgtcagctcaaactcataaacacatcacaattgtaggtggtggctatgttggggttgaactggcagaggcatacgcggatacagatcatgaagtgacattaattcaatcgcacggccaagttctaaacaattatgtagataaaactttatctgatcaaattacaagtttgctaaaaaagcatggggtacatgtttatttgaatgagcgggttgaagcctttcaaggtgacgatcaaaatgataaagtaatcattcaaactgataaaacgagccatgaagcagatttagcaattgttagtactggatttatggcaaacactgacttattgcgtggacaagttgatatggaccgccacggggctattttaactaatgattacttgcaaacctctaatcctgatgtgtatgcagctggggatgcttgtatttcacatttcaatccggcacataatgatgcctacatccctttggccacgaatgcagttcgtcaaggagctcttgctggtaaaaatatttttggcgaagttcaaaaatatatgggaactcaagccacatcagccatggagttgtttggatacacgctggcttctagtgggctaactgtagcgggggctaaaaaagaaggcttaaacgcagcctcagttgtttataagggcaattatcgtccaagttacatgccaacaacagacatgctgaccatcgtgcttgtctatgatcgcagtaatcggcgaattctgggagcccaactctatagcaaacatgaagttgcccaatctgcaaacacgatttcggtttgtattcaaaataacaacaccattgatgacttagcgtttgtcgatatgctattccagccacactatgatgaaccatttaactatttgaatttggttgcccagttggctattgaacaggaacgacaagctcaaaaggtaaaatagaaattagcatgactcaaaaggtgaaaacacctagtttcaggtcacattttgaatagacaagttcataaacttaagtcaagctgggaaaacatttccccagcttgtttttttatggcaacaaaaaaagcattagctttgcactaatgccaaaatgattagtcagttttttacccaaccttttgcaatttttggggttcctttaagagtaaatgaccaagcagcgccaaaattaagaaaacggcggcgacactgcaaacgcctacccagcctaaatgactccaagccagagttgcgaaaaatgttcctaaagaaccgcctaaaaagtagctaaacataaagacggagttatttcgactgctggcttcgagactcaaggattggacaatagcctgattggaaacctgaccaaactgagttcctaaatcgagtaacacaatgcctacaattaaaccgataaataattggccaataaaagcaaaaataacaaaggctaacgttgaaaagagaatccctaagccaatcgtcattcttggcgaataggtatcaactaagcggccgataattgaagcaaataagacaccagtgatgcccaataaacctaacaaaccagccacaccactcccgagatgatattgatctgctaagtagaaagcaagtgttgaccacaaaacattggaaacaccaaacaggcaaaaaccattaatggcggaaccttgtaaatgtttttctttagcaagaagtttgggcaaggaagctagaaccttgccgtaattcattctttgatgttgtcttggatcacgcggcaagtacaagtgtaagatcaccaacaaaatggtacagatgaacgctgcaattaagtaaacgtactgccagtcaagaacgctccccaacaatccgctgaccgagcgtgaaagtaaaatccctgttagcaaaccactgaggacattgcccaaaactttcccttgatgcaagctaggggctagataagcggcgtaaggaattataatttgaggtgccacagaggtaattcccactagtagggaagcaacgccaaaaattgtaatagatggggcaaaaaaggccatgaacaacgccaaaattgagaatcccaacatcacctgaataagatgatagcgattaaagatgtcgcccaacggaacgattaaaagtaagccgaatgcatatcccagttgtgtcaacatggcaaccacaccgactgtagcttttgaaacttgaaaacttgtggcaatgagaccttcaattggttgaatataatttaaattggccacaatgatccctgtggcaaaggccattaatagaactttttttccagataactctttttgtgaatccaaatttttaccttcttcgtttgaatgagtactaaaagtagacgactagttttagtttaatggcggaaaagggttttcgattcgcataattaaccagtgaaataaacggttatttaacatgttgtgacctccgtaatcaatttagtttaaacaaaaatgtcactttcgtaaagcattgccgagtttttgtattaggagtcgttaccgatctgtaaagtagtgacggttctttgtcaggggtctttgtgataaaataaacctagtacacaattcgaggagaaactatgaaaaaattacgtttagcagaaaggattccggtgtttatgcggaatccccgcttacgcttgttggcaatctatattattttgttatcactcgttggcgcgggagttgcgttttattataactgggtattgggagtcgtcttattggtacttctcattttgggaagcatttttattagcgacacttttcatcgtgtgaatgaagaaaccacaaagtacatttctgatctgtcatttcgaattaaacgtagtgaacaggattcactattgcgcatgccactgggaattttgatttatggggatgaagaccaagtccagtgggttaatccgtatatgcagggctatttaagtgataaagatgtgcttggaaaaaaattagttgatgtcgataaagacttggcaaaaatgttagcagatcaccgggatgaaaaagggaccgttcccgttgtttggggggatcgtcggtttaccttactggttgaacaagatagccacgttttgtacttaatggacattaccaagtatgccaagattgaagaagcctacgataattcgcaggtcgtcattggtcaagttttcttggataactacgatgaagtcacgcaatctatggccgattcggatgtttccagtttgagcagttttgtgacgaatcaaatttctagctgggctcaagagtttggcatgtatttaaaacgagttgatgatgatcatttttttgttttgatgtatgcggaagtcttgcagaaggttgaagctgataatttcaagcttctggatacgattcgggaagcaacctctaaacaaaactttccaatcaccttaagtattgggattgcatatggcgatcaagatttaaacaatttggctgacttatcacaaagtaatttggatttggcgttaggacgtggtggtgatcaagttgttgtcaagtcaccagatggccaggcccgattctatggtggtaagactaatccaatggaaaaacggacacgagttagagcacggatgattagtcaggcggttactgaattaatgtcgcaagctgatcaaatttttgtgatggggcatcagcagtctgatatggattctttaggagcctgtttaggaattcgccggattgcccaaatgaacaaccgacaatgttggattgtgctcgatcaagataacctgcattctgatgtgcggcgtttgttaacgtctttggaagactatccttctatcaaggagtccattattacgcctgaagtggctttagagaatgccaatagccaaagcttactcattatggttgatcattctaaaccatcattaacgacggctcctgagctttacaagaagcttgaaaatcgagttatgattattgatcatcatcgccgaggcacagaatttccagaaaatccggttttggtttatattgaaccctatgcttcttcaacgtgtgaactcattacagaaatgtttgaataccagtctaaagatagtgaaccaattaatgaaattgaagcaactgggatgttagccggaattgaaattgatactaagtcctttaccacaaaaactgggacgcggacgtttgatgctgccagttatctacgatcagttggtgctgacgagaatctcattcgccactttatgaaggaaaacgttgatagttatctgcagcgcaaccacttaattgagtcggtggaatttattaataagaatttagcagtttgtgttggtgaagatgatcgggattatgatccggttactgccgcacaagcagccgattccttgttatcgatatcaggaattgaagcgtcgtttgtcattacgcgtcgatcgaaaaaacaagttggtatttcagcgcgtagtgcgggggatgttaacgtccagctcattatggaacaaatgggtggcggcggtcatttaggtagtgcagcaactcagattgaaggtcaaagtgtttctgaagttaaagcgaccttaactgagattttagaaaagaaaaatgatacagaaaatgaagacgatgaaaaggagtgaatctgatgaaagtaatttttttggaagatgttaaaggtaagggtaagcgcgggcaggtcaaagaggttcctgatggttacgcgcaaaacttcttaattaaaaatcataaggctgaattggcaacaaaaggtgctttgagcagtttgaaaggccaacaacgtgctgaagaaaaacatgaagaagaaattttagaagccgctaagcaattaaaggtcactttagaagatgacaagacagttgtcgaattgactgctaaagcaggcactgatggccgtttgttcggttcaattcctagtaaacaaattgcccaagcattagataaacagttcggattaaaattagataaacgtaagattgaactcacccaaccaattcgctcaatgggatacacgaatgtaccagttaagttacatccacaagtaacagccaaaattcgtgttcatgttgcagaaaaataatagcaataattgttttgtggtgaagttggctgtctgattacaggttagacagacacaaatttgtttaggaacatttcctagtcatcagaggtaagaacatggataatgacattttagaaaatcaaacaccgccacaaaatagtgatgcggaaaaagccgttttaggggcaattttccttgattccgatgtgttagttgacgcaatggaatatttaaccccagaagacttttatcaacgggcacatcaaatcatttttcaggcgatggtttcgctaaatgatgaagatgaggccattgatgtcgtcacaatgaacaataaactaaccgctcaaaatcaattggatgatgtgggtggcgtaagctacattgcagaattggcggcttcggtaccaactgcagctaatgtggtttactacgctaagattgtgcaagaaaaggccattttacgacggttaattaaagctgccactaagattgtgaccaagagctatcaacaagatgaagatgtcggtaccgttttagatgaagcagaacgtgaaatcacggaagtttcagaaaatcgtaatcagtctgggtttaagaaaatttccgatgttttgaccgattccatgaccgagattaacaagctctaccaaaacggagatgaaatcactggtttatcaacaggttatagtgaactggataaaatcacggcgggtttacatccagatgaactttttattctagctgcccggcctgccgtcggaaaaacggcctttgctttgaatattgcacaaaatatcggtaccaaaaccgataaaacagtggctatttttagtttggaaatgggcgctgatcaactggttaaccgaatgctttgtgcggaaggtagtatcgatgccaaccatttgcgtactggccaactaaatgaggaagagtggcaaaacttagtcattgctatgggtagccttgcaaaagccaatatttatattgacgatactccgggaatcaaaatggcagaaattcgagccaaatgtcgtcgcttggccaaggaacagggcaacttgggtttagttgttattgattatttgcaattaattgaaggctctggtcaagaaaaccgacaacaggaagtttcagcgatttcgcgacaactaaaaaaactggctaaagaattaagagtacctgtattggcactttcacagctttctcgtggcgtggaacaacgtcaggataaacgacctgttttgtctgatattcgtgaatctggatcaattgaacaagatgcggatatcgtggcgttcttatatcgtgaagattattacgatcgggatgaagacgacgatagcgacaatcagaattcagctccacaacaagagggtgaacctgatgtcggaccggttgaagtcattattgagaaaaaccgaagtggggcacgaggaaccgtaaaactgttatttgtgaaatcatataataagtttgccccaattgcgtatgtaccagataataattaagtagtcacaaaaaacagttttgcgtagctcttcggaaccttatgtgaaactgttcatttatgcacttttttctttttgctgccatcaaggtgcatgttgccatcaatgatgaaccactaatctgccgatgttagtggttaaatatcactctcagttgatattactgcatcatctaacagcttctgccactcgtaagtctagtaacactctgaaggggatcttaactccaagcgtcatgatggcaatggaagggtgattccccaattgggggacatcgacaatattgaatcacgtcaagtaaatacatggcgtacaccttctaataagcactcgatctttcgttttgaaggatgttgaaggatgtcatctttcaaggatgagtgtatcatcccgacagcctaaaagttttgtgtcttcctccaaaaaattaacgtttttttagcacaaatgtccaaaatcgctctcgacaaaacatttgataacaaaacagctatcattttggcaattcatatgtactaagatttaaaaaagcgttaccataatggtaatgaaaccgtcggattttggaggtgagatttgtgattgatttgcagaaaatcgccaataaagagcaaaagtacattgttcaagtcaaccaggtaccgttggccaatcgcaaggtcaacgcgattaccattatggacagcggcacggctgacggctgggcacaggccggtcaaatcgtgattaccagttctcggatgatgcccgaaaagattgagacagccaaaacgttgattcaccaattagtggaaaaacaagccagctgcttgatgattaagccttacgcagacaatgaggaatcagacatcccccagacgttaatcgattactgtacgcacttagccttcccgctatttcaaattcgggaaaataccacctacattcaaatcatgaatgacattaacgccattctgtttgagggccgccggatcaataagatggccgatttggatctggactatttattaaaaaccaattccgcttcggataaagacttcgacttcatctccagtttgaagaatgttgacctatacagtctcaaagtgagagtcgccagaatctcattatcggaaatgcccaaaccaagtgaacgaattgctgtccagttcaacctgatgaatcaaatccgggcgttttttgaccgagtccaacaggaaaaacgaatcaaaacctactttatcgttgaatcagctgatggtgcgaccgcgatttccttctttgaccacgaacaaatggaattgccgcccgatgaccgcattccttttaaacggctgattagtaatgtccgcattcctcgttttaccgtctacgagggcgtctccaatgcccacccggccaaaaaaattcatcgctcctatattgaggccagcttcggcatcaacatcgctaaaaccttggactggtcacgacggccaatcttttaccgggacgtcagcctgtgggacctggtgaaaaagctctcaagagttcaagatagtcgtctgtacccggaagagatggaccagttattggagaatcatgagatgtttgaaaccatccgggaatttttcagacaaaacgaatccgtcaaaaagaccagtcaagctctgattacgcatcccaacaccgttcgttatcggctggagatgatctacaaacgaactggtctggattaccggctgaccaatgacaagtttttaatctacattgcctttattaaaaagttattagccaaagtgaataatgaatgaccatcgcacaacggcaccaacccgagcaaatcgagttggtgccgtttttgttttttgaatagactcaacttaccagggaagcgtcccctcattctcggtaaacgtcccattcagttcattggtaggatcactggcgagcttgataatctgctgggccccctggtggaccgactgcatcccttgtggcaccggctggctgacatcacggccgccaaaggaagttgcggtccatcccgggttaacagaattgactgtgatgtgggtatccttgagctctttggcaaatgtaatcgtggcgaagttcaccgccgctttggaggattgatagcccagggagctaacgtgatagaagcgcgaattcggatctgacgccagccccagcgagcccatattgctggaaacgttgataatcttggcagacttggatttctttagcagcggaataaatgcctggatcatgctgacggtgccgaagaaattaacatcaaactcagcccggatcacattcgtggacaaagtttcggcgttttcgtgattatccaaagcaatcccagcgttattaatcaaaacatccaggtaaccgtatttttcatcaattcttgccttggctcggtcaatatcactttgtttggtaacatccaaaatcaccagctcggcatcataacctgcctgccggattttatcaacggcttgctgcccttgatcctgatggcgggatcccaataagacatgttggccgagtttagctaacgccatcgccgtttcaaagccgatccccttatcagcaccggtaattaaagttaaagttgcagtcactgcaatcgcctcttcaatatcaattttctcaattataccccatataaaaaggccaagaacacaattgctcttgaccagattatagaaggatgaagcttaatcatttattcaaattcaattagtcagctgacatgtaacgtcctttggtaatttgtgatgaaagaacgtaaccatagcccttaacatataagaatgtcttagccttggatgtcttagttgcagcgactgtgaccgaacgggtaacactatatgtcattggtttggtcaatttacctttaggtgtaaaggttaccttgccagcatcggcatagaagaagcccttatataaggtaatgttcttcttaatgtgatatgcacgcgccttgaagttcttaacaccgttcttagcaatagtgtaagtggtacctttggtcttggctgcagtcgtggtcggtgttgttgcggctgatacggccaatggggctgcaaaagcaagtggtaatgccagtgaagctacggtaatgattgttgcaaattttttcataatcatgctacctccctaaaagattaaactcattatgccacgttacaggatgatgtcaatgaaatgttggtgtaacattttcacctttaccaaatattaagttagcggttaccatttgattatgcacaatcttattagtgatgaatagactgatataacaatgtttcattaatgtaaaattcacaaactcgtatatcaatcttcgcctaattgtcgtaatcgttttgtaacattagcaactcattcacaggtccggcagcgtttcagtttcttttaattctgagcgccacgaagcaaacgtaaaaaagcggccaaatcattgtaaagatttgaccactttcatacgaactcatatatcgactacttttcctttgaacgcagcagttcttccaatgatggttgttgcttgcgatcaatgtgatattgctttgcaaatccttcagcggtctcttcaccgtacttttgagcatccaacggcataaaggcagttgcgaccggatcgtcctgcttgatcttggcatcgataacgattggcttttgattgccagaggcctgcagatccttgatcttagcaaagacctcatcgagatccttaatgctcttgacagtgaagccaattgcacccaagccttcagcaactttggcccagtcagcatcgttcaagtcaacaccgtagaagtgttgcttggtctgcatttgttcgtaccagataaagccgaagcggtcatttgagaagaccacgttgatcactggcagcttgtagcgaacttcagtcaaaatgtctggggcgaccatggcaaaaccaccatcaccagagagtgaccaagcttgcgcatctggaacgctcaaagcaccagcaagaccgccaggaaggccaaagcccatggttgcaaacaatccggaaattgcgaagcgttggttcttgttcattggcaggccacggacaccccactctgaaacatttccagtatcgacagcataggtatcgttaggaccagccaactcggcaatcttcttggtaactgattcggcgttcaaaccatcgctgtcatcatcagccaattgctcgagccatttgtcccagttctgcttattctcttggttggcttcgagccaagcatcttttggccgactctcaccagtatcaatcattgcttgtaagtaactcttggcgtcagcgataacggcgtaatcaacgtcgattcgtttaccaatatcgtaagggttattgttgacttggatcatcttggtatcttgtggccaatagttggcaaatggatactctgaagctaagaataagatcaaatcggcgttttgaatcgcctcaaatcctgacttagtgcccagacggccagtcgctccgacaaagttaggatggtcggtgctgatcacaccggtggctggcacactgttcatcacaggaatgttaaactgctcagagaacttggttaaggtgtcgcgagcgcccaacaagccacggcctgcataaatcaatgggtgcttggcttctttaatcatcttcaaagtgtcgtcgacagctttcggatccacgctctgtttgaaatcgtcagcaaccgttaatggcgtgcgagttggtgtgtaatcaatttcttgagaggttaagtcttctggcaagataaccacggcaacacccttttggcgataagcttccttgattgcttggttaacaacgtaaggaatctgatcagcggttgtgacttgtttgttataaaccgaaacgtcgctgaacatcggggtttcatccatttcctggaagtaattggtattcattgttggctgtggcacttggccaactaacgccaacactggaacatggtccattttggcatcatataatccgttgaataagtgtgttgcaccagggccggctgaaccaaatgcgacaccgatttttccggtgaatttggcatcagcagaagctgcaatggcgccaacctcttcatgacggacctgaatatacttcattttatctttttcaaggtagagtccttcgacagtatgattaattgagccgccgggaattccatagacgtggtccacgccccagtcttcaagtactttaactaaagcttgtcctgcaatcatcttagtcatcaacaaaatctccttcatttagatatcatgtaatggtgaaacaccaatatatctttggttcaattattaagtataggcatgctgaaaatggaatgccagcatttagacttacttttcgtaagtataaccagttggtttaatgtaaacttgaaaacgataaatgacgtcattataaatagaaaaagtgttgggcattttcagatgtccaacacttttttcagttgatttgcatggttaaaaataagttctcagaaattcctgaacccgccgcttataagccaccggatcataccagaaactctcggcatgcgtggcgtttgggacaatccagatttgcttgggtgcgtgggtggcttggtagttctcgtaagccatgtgggccggcacataagtgtctttgccgccatggataaatagaattggccgtttgttcttggccagctgtttgaccgatgaagcactgttgaggccaaatccggcagcccgtttgttaatttcactcaccattggttcaaccggatattccgggagatgatactgtttcttcaacagataagtgagttcttccttaatgcttgaataggcgcaatcggcaatgatggctttgacctgagtaggcaggcgttcacccgacagcatttccaccgtcgcaccacccatactgacgccgaaaagtaagattttaccgtcttcgccaacgtggtcaatgacttgatcgatccacttcaggtaatccaaacgatccagccagccaaaactgatgtatttgccggcactctcaccatgcccacggtcatcgggtgtcaggacattaaagcccatttcgtgaaacattttggcgtaattggccattgtttcccggttccccttatacccatgggcaatgatgaccgtcttcttggaaatgccctcggccggaatgtaggttgccaccatccgcttgtcgggatcattgcggttcaaataccattcttcagagggcatttgatggaaccaatccacatattgatagtagagatcggcgtactgctgcttttctttcgaagtttcagggacataatcgacccgcttaaacgcgatgtcaaagagtttgagactaacccaaaaactgccggcagtaatagccgtcagcggtaaaatcagtgttttgaattttgatggtttgatgtttgctaatttcattgatttttgttaatcccccttaaacgttagtattaatagtagttactcgttggaatgaagtcaaacgactttacttttgtttaacaaaaacaaaaactcttccaagtatcagggaattttccgcttccacagatattaaaagagttttctttcatttttatcattatttcgaaatccagtgtgagataataacagcattatctcaattccaacgacaaggtggttatatcatgaaattttcagtcctcgggccagccggcacctttgccgacggagccgcgaaagcttatcttaaaacccagccattaaccaacgtgacttttgactatcatcccactttcgatcaagtctaccaagccgtttccggcgacaaccttggtttattgccattagaaaaccagcttgacggttatgtgtccgcaacccttcaacgcctgcagaccgccaacgtcacggaaatcggcgaagtcaccattccagttgattttggcctggtagcaaacgttgctgatttacaacaaattaaacgactttatgttcaattcaagactgagggtcagtgccagaagttattgtcaaccatccccaacgtgcaaatcatcaccacatcatcaaacatgatttcactggagaagttccagtccggccagccgggcgacgcggcgatcatcccccaatcgcagatgggcgatttatccgcaccgttaatgatggataatgtcgcagaccaagacgataacagcacgcggttcattgtgttcaaatcaagacgagcgcacctggataggcttgcccagcaaacattagtgactgaccagttcaaggcaccactatttgtcacgccggctttcaacgatcacccgggaaccctctacaacattctcggctactttgcggccagccaattaaatctggtggcattaatgtccttgccgaccaaaacgcagttaggggtctattcattttatctcgaagtctctggaacccgtgatcagcaagctgatctctttaagacgcttgagcgaatggctgccaattatcaggttcatcccctcggctactatgctgtctgagctgctggggcctcctgcttagccttgatggcacgttgcttggccaaattctgacgatgaaattctgccaggtgaacagcttgggtaacaaacaaatgggtgctggcttcataatggtatttacggccaagttcggcaatgtagccgttaatgtaatcaacttcagttggccggtccttaatcatatcctgatacattgatgggtaatgaagcggcatatcgattcgggtgttgtggtcaagggcagccatttcttcgtcacggctggaaactaatttgatatcagctcgggcacaaatgtcataggcttcatcaaacaattgccggcccatttgataagcccctttgaagttgccaaattcacccattggtaactcgaacatggtacaaatcgtgttaataactgagttaaagataaccttggtcatcaaagttccggtgaagtcatccgttaaggttgggttcatcttggctttttgcagttcatcgaagagtgcctggcacattgcgtccggcttttcgttgagtgggcacatgttcatcttgccggcaccccgcttacccatgaagtcaacctcgccgggaccgggaagcacggtcgcaattaacgcggttccgccaatgattttgtcatcagcgaagtacttctgtagtttttcaatgtggcccatcccattcatcgcagtgaaggcgtattgatcttcgtggaagaaatgtgaacagcgatcaagataatcttgcagctgcatttgtttggtaaagaaaataaacatgtccggatggccatcaaaggtttctggggtttccaatttaatcttagtcaaatggcggtccttatgatcacgcatcacatatacaccaccctgttcacgaatcttgtcgatatgtggctgccatgtatcgataaatgtgacatcgttgccagcctcttgcagtaaaataccatatcgtaatcccattgcgcctgcaccaatcattgcaaacttcataaaaaccacactccaattttctattttatttttgactgaaaaaagcgcccctaatcttatctctaagattaagggcgctttcgcgtgttaccacctaaattcacgatctgctcacacaaatcgtctcatcatgtacggccattgctgacgatacactggcactttaaggggtgcacaccgaagatactcatcacttcgcatctactgcttagaggctactttcaattcgatcaccatcatcccttctcacttaacgggactccctgaaatggttagacgaatctactctcctcatcgctgcattttttcaatcaaattttaatgtgcctataatctaactcacgagattttaattgtcaaccaaaatttggaaactttttttaaaatgcctgaagcagcctcggagaatccatttgtagtcatggtttgaaagaatttccgtttttcgcgttgacaagtgtaacctttggcgataagatatagacaattaaagtttacacatgtagattttggacgaatgggagatgggtttttgaaaatagttgttttaattgctggattagccttgattggttttatcggctggtggttcttcggcaagcaccaagttgctcaaaccaacgccaaggttaacgatgatcagcaaatcgtcgatgttgaggtcaaaggtggctattcaccggaagtggttgtgttgaagcaaggcgttcccgcgaccctgaactttacccgaacagattcatcatcctgtttggatcgagtcgtcttttcggactttggaatcaaccaagcgttaccgcagaaccaaaaagaatcagttgaaatcgataccagccaatccggagagttccaatgggcctgcggaatggatatgtttcacggcaaattagtgattaaataaatggaggaatcaatcatgaatgaaaataaacaaacagttaacgtaaccgtcgccgggggctatcagccatctgtcatcaaattgaagcagggtgtgccagccgaaatcaatttcaaacggattaatgaccaggggtgcttggatgttgtccattccaatgaactcggcttttctgaagaactcccagtcaacgtcaccaagacggttcaagtgccaacggaccaggctggcgaatttggttttagctgtggcatggacatgttcaaagggaaagttgaggttgtctaatgactatcacaaaacgattttggatcgcactgattttttcgctgccaatgttggcggagatgattctaaagccattcggctggatgatgcctggcggggaatggacaatgtttattctgaccacgatcgtgatgatcgtcgcagccggcccattcatcaatagtgcctgggcatcgtttaaaaaacaccactccaatatggacaccctagtggcgatcggaacgaccacggcatatgtttacagcatttatgcgatggcaactcaccagccggtgttctttgaaagtgcagcattcgtgaccacatttgttctgcttggacaggtctttgaagaacggatgcgcaacaatgcctccaatgccgttgaaaaattggtcaatttacaggcgaaagatgccgaagttgtccgtgatggcaagattgtcagagtcccaatctcagagattgtcgtcggtgacctcatcaaagttcggccaggtgaaaagattgctgttgacggccaaatcgtcagtgggtcatcaacgattgacgaatcaatgattactggcgaaagtatgccggttgaaaaaaaggccggtgattcagttgttggcgctacagtcaatgggactggaacgttcactttcaaagcagccaaagtgggcaaaaacaccatgctggctcagatcgtcgaattggtcaaaaaagctcagaatagtcatgcgccaattcaaggattaaccgataaagtctcggaaatctttgtcccgctggtattgataatcgccatttcaaccttcttaatctggtacgtcttcattggtgccagcgttgccaacgccctgatctttgcagtctcagtggtcgtcattgcctgcccatgtgcactcggcttagcaacaccaaccgccttaatggtgggaaccggccgcagtgcccgaatgggaatcctgattaaaaatggtgaagttttagaggctgtcaacgatgttaaaacagtcatttttgataagaccggaacgattacggttggtaagccccaagtcacagatattgttggcgacgccagccaagtcttaaagattgccgcaagtttggaagcctcatccgagcatccattggcaaccgcaattatcaagaatgccaaggagcacggcattgattactcacctgctgaaaacttttcagccattgaaggcaagggcgttcgagccgtggtggatggaaaaagtgcctttgtcggcaatgccaagttgttgaatgacgttgaagtgagtgacacatttaaacaacaaatggcaactttacagtcacaagccaaaacagtcgtctttgttggccaaggtcaccaaattattggcctaatcgccattcaagatgctcccaagccgacttcaaaggatgccatctcagcgctcaaatcacaagggctaaagacagtcatgctgactggtgacaatcaggcagtttcacaggcaatcgccagccaagttggcattgatcaagtcgttgccgacgtgctgccagccgacaaggccgaccaggtcaagcaatttcaaagcgccggcaaagtggcgtttgtcggtgacggtattaacgatgctccagccttgagcaccgctgacgtcggcattgccatgggatccggaaccgatatcgctattgagtccggtggaattgtcttagttaaaaatgatctccgcgacgtttacaaggcattggaacttagcaagaagacatttaaccggatcaagttgaacctattctgggcatttgtctataacgtattgggaattccagttgctgctggagtattctactttatcggaatgaccttgagtcccgaattggctggtttggcaatggccttgagttccctgtcagtcgttaccagttcagtattgctcaatcgaaccaaaattacgcctagtgcacaagtggcataatctaaaatataaaatgggcaaccgggacgtgtcaaaacacgagtcggttgcccatttgcatacataatttgaattggttattgttcacccagcagtcgtttaagcctggcaatccgctcatccaacggtggatgggtatcaaacatcttggccaaaaaaggtgtttttccttgccgggtgaccggctcattaatataaagcgcggcactcttggcagtcggattgttggttggtgtggtgtcattttttaacaaggttaatgcattaattaagccttgcggatcccgggtcaaattaaccccggaaacatcggccaatgattcccgttcacgtgaaacagagaactggaggatttgggcaactggcactccgactgcgcggatgatccagccgccgagccacatgatgagtccaaaaactaaaattccaaccgcaattgcccaactggatttggcgtcatcgtcgctgtcactgccgaaccagctgaaccaacggccacctctgattaagctgattccggaaacaatcagaactgtcccggccccggcaataaacgtggttaaggcaacggtaatcgatgatactcggatatcgtagtttttgatatgcgagatttcgtgcgccaaaaccccttccaactcttcacggttcatcatttcccgcaaacctttagtaaccgcaaccgcagcgtgttgcggatctcttccggttgcaaaggcatttggagaaggatcatccgtcaaatagattgccggcattgggatatgggcaaccatcaccaagtcactgacaatgttaaacaattccgggtcgtctgattcttggagttgatgcgcattggcagatttcatcaaaatgttggtcacactcatgtagacaaagaacgaatagatggccgccccaatgagaaagccaaccatcgtgtaagtcggaatcagccaatcaatactttcatcttgggtggcaaccgcaaacaccaacccaattagaaagccaataacggcaattaaaacaacaaagaaagccatgactgaccaggttcgtcgtcgattctgctgaacttgctgatttatggtatccattatcagtcaggcccctttaaaatttcatttgtggtacttctttggactgttcaggaacttccagataagaacgagctgggaaggttccgaatttggcaaccaaattacttgggaaggtttgcagtttgttattatatgccatgacgttactattgtaattctgccgtgaaaaggcaatcttattctcggtattggtcagttcttcctgcaatgccaagaaattttggtttgcctttaattcgggatagttttcggaaaccgcaaacaaatgattcaacgccccggttaactcattatcggctttaaccttatcgcccagactggcgttggggtcttgaatttgtgatctcatcgcggtcactttttcaaaggtttcctgttcgtgcttggcataacctttaacggtttccagcaagttgggcagcaagtctccccgtcgctgaagctgaacgtcaatctggctggcagcttcgtcaaccaggttccgttggctaaccaggccgttgtataaggcgacaacgatcacgattagaacgatgatgataattccagtaattaatagtcccattgtgtgttcctccttgcgttgtttcacttaaatgtatcatatcagccgccaatacaaaaggtctcaggcccatttattgaataagcttaatctgcctaagtcgtttcacgaaacattttaagccttgcttgactatcttttcttaaactcttaaagtattattaaatatatattaaagaatgattaggagtgattaggatggttgaaacagcgcccgttacagacgaactcgatcgctatatgatcgagcaatttaaacaatttcatcgccaccccgaactttgtgatcaagagaaatggacaacggccaagattgccgatgagctgcatcaaatggccattccaatcctgaattttcccattcaaagcggccttgtcgcccaaattggcccaggtaatggtccaacaattgcgttgcgtgcagatattgatgcactaccgctccaagaagaaactgatttaccttacaaatcagaaatctccggcgcagcgcatgcttgcggacatgattttcatattgcggcactcttaggggcagcgaagttactaaaagaacgagaatcgcagttatccggcaatgtccgcttaatctttgaacccggcgaagaacgccacgttggcgcacgggaaatgattcatgcggggatccttaaagatgtcctggcaatctctggaatccacaacatgccaaccattccagtggggaccgttggcatgaaaatcggcaagttgatggcctccaacgacaattttgacgtgaccatcaccggagttggctcccatgccgcaatgccgcaaaccggccgtgacccaatcgttgccgttgcaaatacgattatgaccctgcagacgattgtcagccgaaacatctcgccttctgatcggctagtcctaacagttggtgccattcgcggcggccatgtcaacaatgtcattccggaaagtgccggctttaaaggaaccatccggactttttccgaagccgaccgcaaacttgccaaacagcggttttacgagattgtgaatgccactgccagcgcttatgaccaaacagcaaccattacatgggatcagggacccgctcctgtggacaacagtgaagcaatcacaaacctcatcgcaaaccaggcaagccaattcatgaaagtcactgatgccatcccttccaacgccgatgatgattttgccgagtatgagcaattaattcccggctgttacgcattcatgggcagcaagggccaggctaacttacatcacccggactttattgccaaccccgaaggcctcaaatacgcagcgaagttccacgagcaggctgcattggcactgttagctcattttaatcagaaagataaggtggaatagcacaatatggataataatgaaaagctgcagattttaaaggatctgatttcctttcgcaccgtcaacggcaacgaacatctggtaaccgcctatattcacgacttgctggccaaacacgggataagctcaactttcatcaaatacgctgaaaaccgagatgacttgattgctgaatatgacacgggtaatcctgggccggttctgggcttctccggccacgccgacgttgtccatgaaggcgccttatcaacttggacgacgccaccttttgaacccaatgtccgtgataaccgtttatatggccgtggagccgccgatatgaaaggtggactcgctggcctaacaatcgcgttcatcagccttgtggagtccaaaagcgtccacaatggcattttgaggctttatgtgactatgggtgaggaagtcggtgagctcgggtcaaaattattggccgataaaggctacgtagatgatctcgacgccgtggtgatcggtgaacccagtggggtctcaaaagagcgcctcgatgcttacgtcgatagtggcggcgctaaattcacgccagaattggcagccaagctccatcaggtcagtcatgaccgaaaatcgcctgaacagcattttatcttctttgcccataaaggctggctgatgtatgaagtcgttgcccatggtaaggcagcccactcatcaatgccaaagatgggaatcaacgccatcgatatgctggtgaattactacctcaaggaaaaacagttctatcaaagcattcaagccactgatccaattctgggcgataccgtgtacgctccgacaattattgccggtggtaaacaaatcaacagtattccagacattgccagcttgaaagtcaaagttcggacgatccctgagttcgataaccaaacgatcatcaagaaactccaccagctgattgatcatttaaatcaacagccagggtacaacctgacaatcgatattaccagtaaacggccggtgatcaatcatcccggatcagcgattatcgacatcgcccaaaaagctggcgcccaccacctgcatgaatctttggacctgccaacgatcggggtgtcgcttggaacagatgcctctgaatacacccgagtgaaccaaaagatggatgtggtggtcctcgggccggggaacacgaccagccatcagcacgatgaatatattgatctggatacttactacaatatgattgagacttacaaagaaattggccaacaatatttgaattaaaagaaataaaatgagcaggatcaccagatttgacggtggtcctgctcattttttactgctattaagttagattcgctttaacttgccaattgataatgcttcttcacgagattggacaggtaactcaacaacccaatcattgccaggtacatcaacgataccagcaaccaaactttgaaaccttccatgtttctggaaataatgattgttccttgctgggtcagttcagccaccccgatcgccgacagaaccgaggtcccttttaatgcgatgataaattggttgataaatgagggtgccataattcgcaaggcttgcggcagtacaatgtatctcatggcttggaaatacgacatcccgttggaacgagccgcttccatttgaccaccttcgactgcctcaatcccaccacggacaaaggaagccgtataagcactattttccataacgatggtgatgaccccggcaataaacagtgggatcttctcacctgttaggttgggaatcccaatgtacacgaagaatgccaacaccatgactgggatactcttgaagacaaaggcgtaagtggaagataatcctcgcaggaacttgtttggcgtggcgcccaagataccgagaataattccgatgatcgtcgcgaagaaaatggcaacaatcgtgatctccagggtcatcttgatcccgttgccaaacgaagtggcgttactcttcaacaggccaaagtatgtccgatcggaatttgattgaactgggatcgctgacttactgtgttcaccagtgtagaatttgacgattttatcgtaggtcccatcttttttgatggcagccaaaccggcattgaatcgtttcagcaattcctgattgtggcctttcttaaccccgaaggcgaccggatttttattggcggccttcccaactaactggagtttcatcttgtttttgattgagtataacaacgtggccgtggaatcaatcgccgcagccgagtttccaaccaaaacgttactcagttcagtgttactatcgttgaaccgggtaatatgaaagccatatttcttttgaatgctttcggcatactgctcagaggttgaaccggtcttaacggcgacggtcttgcccttcaaatcattatatcctttaatcgaactcccctttggcactgccaatgcgaggccaacattataatatggctttgaaaaatcaatcttctcagctcgttccggcgtcgccatcatagcggcaatcacgccgtcaacttggttgccttccaacgcttgaatggctgccgcaaagttcatgactttcaacgtgtaggtgaagttctccttcttggcggccgcccgaaggatttcaatatcgagaccagggtgagccgtattataagatccgttcttggcctgaatttcaaacggcacaaaggtcggtccaacaccaattgtgtagtgttcttttgattgtgcggatgcaacattattcattaggaataaaaacgagaacgccgacacaaatataattaataatcttctaatctttttcaaaatactcactcctcaaaaatggcttttataaaatatagcattttatcagcactatgggaagaggttggctcaatttagatgtcgcaatacctcacatatcattaagcttaaagccgcttgcgggttgattttaagggaatgatgagtatttatctaattattcaaatagatattattcatattttgtatattttatacaaaaagttggaactgagagattgatggatctttgatgctttcaataagtgctcatcaaaggtatttccaccaaaaattcagttccaacttgttaagtgcttatactaatccttgtgccatcatggcttcagcgaccttctcaaatccagcaatattggcgccagcttgatagtccttatccaaatgatattttttgtcagcagcttcggacttggtgaaaatatcttccatgatgtcttgaagccggttatcgaccgtttcaaaactccaagccaaccgttcgctgttttggctcatttccaaagcagataccgccacgccgccagcattggctgctttggccgggccatacagaatatcgccgtcacgataaattgcaatcgcatccgggtaactcggcatgttggcaccctcacagacatacttgacaccgtctttgacgatcaattttgcctgatccttgttgatttcattttgagtcgcgcatggtaaagcaatgtcatagtcaacgtcaaaatcccagacagatccaccatggtattcagcggatgccacccggtcggcatattcacggatccggccgcgttcaacttctttaatctgctgaacaactttgtagtcaattcctttggggtcataaatgtagccgttggaatctgaaacggtgatgactttggccccgagttctgtggccttttgaatggcataagtggcgacgtttccggcacctgaaatcttgatcttcttgccggttaaagtgtcgccctgggcctttaacatcgcgttagtgtaatacagcaagccaaaaccggtcgcttcagtacgggcgagactgccgccaaatgtcaatcctttaccagtcaacacgccattttgataaccattcagccgtttataagcaccaaataagtagccaatttcacggccgccaacaccaatatcgcctgcaggaacatccaggtcaggcccaatgtggcgttgtaattcggtcataaagctttgacagaagcgcatgatctcagaatcagatttgcctttggggtcaaaatcactgccacccttggcaccaccgatgggcaaaccagttaaactatttttcaaaatttgttcgaagccaagaaatttgaccacgctcaagttaacactgggatgtaacctcaaaccgcctttgtaaggaccaatggcggagttaaattgaacccgaaacccacgattgacattaaattggccatcgtctgactgccaaggaacccggaattgaattgcccgttccggctcgactaattgtgcgagcagattgctcttcacatattctggatgggcctctaaagttggttccaggctatccaggacagtaaatacagcttcctgaaattcggtttggttcggatctcgacgatcaatttgatctttgattgattcaatatatgacttaacgttggtcaaaattattcccactttctatattagcttgtgtgacaaatacatcctgtaaaccgattgtagactcacaaccgtcatttacatcattaggtaatatctaagcagaaattttattagaagtcttcacattttattatatttatcaaatatatattcagtaaaagaggcccaaaccgtttattcaacgatttgagcctcttgatttattagtgggtaactcggaacacgaatgggttcgtgaaagcattatgtcagaaataatgtccgaattgtgaaatactgcaattttctgaatgaatgcatcaccaccttatcgaataccaatggcaccaccacacatacggaatgtgttggcattgatacgttcctggccattagtggtcaaactaggaagaatagcagtaattggtgtttgaataccagtgtaaataacaccagcggccaagatataagtgaacccggcataccagagcttagcggtaccatgcaagtttggtgcggtgaaggctaagaaagttgcaacggcaagtagttgtatagcaattgatctggtgtgagggaaagcatccagttaatgtttctttcgaacgtttctttcaaagtcgaatctggcaaatatttaatgtcgtaatatgataccggtttcattttgaattgccctttctggaaacaaatttatttaatgtgatcagcaaatcatctgattctgtaaccgcttacgatatatagaataccgtgtaaacggcatcaattgaatctaaaaatctatcaagtgtttataaaataaaacatatttataaaagcgcttttataatttgctgaacaagcaagaattcgcgtaaaaatagtctttagccaatttctttgtgaaatataaaactgatttgaaattgactttttatgctttctgaattatttttataacaacaacagaaagatttataaaatcccaattgtgatcagcaaacaattcgattttgcactggaggttattctatggttaagcaattcctatcgatttcatgtatcccgacaccgacctatattcaaagcggccacgtggtttttagtcccggtgagcggcatcccaaccggaagaatttccaattctttgtcatgatgttcatgaaacgcggaaaattatttatcgcagaagataataccgaatacaccgtgagtgccggtgagatgttcattctccaaccacagcaccatcactattcatggaaaccaatggatgaaaccactgaatactactggattcactttgcaacagccggcaattacgtccaagcccgggaaccaaagcagatgcgaccagtcattcccgtgccggcaattcattactacacctcggccattactttatttttggagaagcaacagccgattcctaatgaagaaacggtgatctcaatgatcaaaaagatctttgccaacagccgtaagtccaatgaaaaccactctgacaccatccaaaattcaattgagttctggaaggcccagcaactattcttggacctgctccagcagattcaggttcaaacatcgcaagagtcgccaaccacgatgattgccaacaaaatccagcgctacattgaagatcattttgacgaaaagattacttatgaagagctaggcaaggaatttcatatccatccgaattctgtttctttatatatgaagaaaacattcggcatcacccccaataatctcctgacaaaatatcgtttggaagaagcaaccaagtacctgttattgacttctgaccaaatcagcaccatcgccacgaaggttggttaccaaaacgtctattacttctcgatggccttcaaaaaaggttatggcatgtcgccttccgaataccgtaagaaatacatcagtctaaaaccaaacacaccggatgacggcgccggtaatcaatttatgtaatgaagaatcctcctgtaaatcaatgagaacaatttacaggaggattctttgttttgttcaaatatctaaagtggttaattcaacttcacttatataatcctggttgattagattcttgcttgttggatccagacattcatttgtttttcgtcacgatttgcccaagcataatatggaatcaatgtcaggtgactcttctcagccgtttttggtgcgtcgaaggtgtacaactcatcttggttatccacatttactgggatagttttcaaagacaaaaaagcaacgtttaagtatgtggcttaaacgttgcttttaagactcattcaaccgacgtataggccagattactcgaacatcttccgcgtagccttggccaaagtcttaatatcccgatcataccgcggattcttcaccaacttagccattggcactccggcaaagtggtaagccgcgatttctcctgatcgcacggcactctgctcggtgaagaccatttgatacggctgctccacaaattcaccggtgaaagctaaattggttgaatgctctggaatcacctttggtcgatccgtcttggcacggttgttgaacaaagcggatgcatacggcatgtatgccgggatgcagttaatcacgctgtccatgatttcctgcttcttatccataatgttgcccggtcccggatcaaccttggataattgacccagcagctcttcaaccatttccttaccagtcatcttgatgtactgtttgttcacaaactcacctttccgtcgtggatacaggaagtagccccaaatcaccgattcattggccttttgggtggtgaaatgcggctggtggtgcacgacaatcgacatgttgacatccttattgcccattggggtaattggtgaagtggaaatgaatgaatttaatgcattgcctggaacttgggtggtaatccgggtaatttcattcaacaaaatatgatcttttgtcgtcaaagtaaagctgacccactcactggcattacgatcgttaaagaatttgtccggattccccaaattatagaaccggttggtggccttcttccaaaggctggccgcggcaccataatccatattctcttcagccggcgtattgaaatcaccaagagtagctgaatcggtaattgaaccgttggtgaagatcacggccgtgtcatcatcaaccggcacgtcttcttcctcgccagtttccgtattcgtcatccgcaaggcagttaccgtaatctcgtcttgcatcggcgtatccttaaattcaaaattagttactcttcgattcaaaataatgttgacgccttgatctttcaagtaattgatcagcggcagcataatactctcatattgattgtaacgagtccggttgacaccgaccaagtgctcgatttgagtaaactcgtaaatcatttggtgcatgtaacgccgtagttcctgcgctgagctttgtacccgaaaggcaaaggtcgtctcccacatgtaccagaagttggtggtaaacatgtgcggatcatccttgaagtaatcagcgatcgtgacgttatcaagttgttcttctttagaatccggcatcatgatcaattcggttaatttcagtcggtccttattattgaagcccatcttgccaccattgataatgcccttgccgccttccatcaggcgggctttgtcaaacgtgcgatgcttggcatcaaaatcacgggtatcttcggcagcggtcatccccggttcagttgcggaaggcactcggcttaataagtccatcagatcaacgtatgttcgatagttgagcatccgtccaccacgggcaatgaagcctttggtgttttccattgggtgaactttgttccaatattctccggcagcctcgctggcaggtgaaccgtcatttgaaccatggtcgtcaatcgagtaaaaagtaatctggttgcccttccagttaccctcttgaatcaaatagaccgcagctgccatgttagccaagccggcaccgatcataattgctttattttttgtcattaagaattcctccaaacaaattatttcgcttcgtactcatcgtacaggtgagagtcatcttcaaaccaccccatcgacttcaaaaggcaggcaccggcaaccacgacaccgattccggtcagtattaacactgtatgtttcatattcaatcgctccccgttaataatttcagcgaaatgcgtttgccaaatccgtctacgcatctgcctatattgtagtagaaaaccggcataaatgtgtgaccgttatctacatatttgcattttttcgtaagcgttcccagtaaccactgttaaaccaagttttcatgttttatgaaagtttttgaaaataaaacttacgagcagcttttatttatggtagtgtaatcaattgtcatgatataaaagttttaagaattaggagaaacattatggaaaaatcgttaaatgcagaccaagcgtctgtcgaaccaaaacaaaaacaagcagccaaaccggttgctcgtccattcttagcaatgttgggcatgctgattggcggctttgttgggatgttgagtgaaacttccctcaacatcgcgttaccaagtttgattgccgaacttcatgtcagcatcggcaccatgcagtggctggtgaccggctacatgctggtaatcgggattgtcctgccgatgtcttcattgcttcagcggattttttcgacccgctcattaatcttattcgccctatgtgattttatcgtcggtgcggtcatttcagcactggcaccgaattttgccattttactggtcggccgaatgattcaggggattgccaccggtttaattctgcccttgatgttcacggtagcgactttaatctttccaccctataagctgggttcagccatggggatgatcggacttgtcatcatgtttgcgcccgctgtcggtccaactttagctggaatgatcctcggcctgctttcatggcattggattttctggttgtttgtaccatttctggtaatcgcctttattttggccttcaagtacctgccaaacgtgggtgacatcactaagcccaaaatcgactggttctcaatcattttgtcagcgatcggctttggcggcctcgtcgccggtgtcagcttggcgagtgattccggttggggctcaccccaagtgattggaaccttgatcgtctcagtcattatcttggcatggtacatccgtcgccaattaaaatctgaaaccccaattctgaatttccgcgtgttccaaaagcatcaatttacggttggctccgttttagtgatgttggatttcgccattattctttcatcaatgtacttactgccaatgttctggcaaaacggtttggcaattcccgtcgctatgactggaattgtgatgctgccagggggaatcgtcaacgcgattgtctcagcgatcgctgggcgcttctcagatacggttagccccaaactgctgacaacgttgggctttggtgtgaccatcgtcggcctggtattgttacttttggccagctcaacttcgccaatgtggtacgtcatcttggctcacatcatcattatgttaggtgtgccgctcgccatgtcgcccgcccaaacatttggcctgggagctttggatgaacaaacttccggagacggcagcactatcatgaataccttccagcaaattatcggggccatggcaaccgccatcgctaccagtttgttggcatttggaaactcggctgctggtcatgtcagccatcaaattgcttttaccaatggggtccacgttggtctgtggtttacgttgatcgtggctgcagtggctttcctgctttcatttaccattaaggatcgtaagcgcgcataattgaatcttgaataaaaatcaaaaaggtcgcaacataattagcaaaaattacgttgcgaccttttttgagtaccatttaaatcctcatggtgcaatcaattccttaccaggttctgtgttggcaagtatcaccaaatactactgtatcgtcaatatttgtgccactgttgccttgatcatcacccttttagcaaaatgcccagaatttaacacaaaggaatacactttcggtaccgttattaactccactggttgggatgcagacgggtgggctttcctttttggtttcttacaagtctcttgggtgatgacatgttatgatgcaacttcacgtatgtcagaagaagttcacaatgccgcatatttgactccattggctatcgctaccgcattgacgacaacagcaatcttaggttgggtcctcgttatcgtcatcactttgaccatgggtactgatattgacagaatcctcaacaccggtacaggtcaaccaattgtggaaatttacgtcattgctatgggtaagacgggtgcaacagcatacctttccctagcatttgttgttctttggttctgtggtgctgtggcaacttgttataccgctcgttctctttggtccttctctagagatagaggtttgccatactataagttctggtaccacttagattcacgtactcaggcacctgtcagatgtgtttggcttattgttgcagtcaactgttgtcttacattgatcaatctcggttctaacattgcgatgaatgctatcttctctgcatgtgcaattgctacagattggtcctacattattgtcattgctgcatttgccctcaacagagagaagatgggtgtcgctaggggtcctttcaacatgggttccgtgtccaaaccagtcatgttttacgcgtgcttgtggactgtttttgtttccattgtgtttttgttccctaactacatgcctgtcactaaggagaatatgaattataccgttgtcattctcggatttgtcttctttgctacaggtggatggtacctcattgatgccagaaaatggtacgagggaccagtctctaacgttgataaagaagaagatgaaggatacaccattgaagtgagagactcatccaatatggatggattcaactctagtaaatctggttctgtcggtaaagagcacagtaaagtgcaagttgcttctatcagtgatgaggattgatacagccaggtgctgcagttgtttaatgcgttttatacaccccttgtatttcatatgattcaatactattcagttattcgttattaattaaccgaggtaattaagtaggtaactaactcgtaatgcacgcaggtctagaaatgctcatccctttgataactgtgagacatttatctactgccccagacaggttatgcgtacttgatgaattttacatcgaatacacatcaactagcagtgtaaatcctatttaaaatatgaatttaataatccagaaatattattaaaattaataagaaaaggaatatcaaaaagaaaaagaacattatcacgtatatttagatttagattaaaaaatagaataccaacacaaagtgtaggaatattaaaaaataaaatatctaataatttattaaaaagtatttctttaaataataatatattaaatgtagaacataatataaaaaaagtattatttaattcagtaaatataaataatgatatatcaatatataatgatataaaagattattataataatttagatatagataataatttaactttaaataatgatttactatataaaaatatagtaggttgatcattattattaaaaggtaaagtaggagctagaaaaggtaaaaatagatcaaatagaatattaatgactaaaggttcatttaaaaataataatatattaatttataatatctttgatgatagttctaataataatggttattctaaagatagattaaaattaaattatataaaaaatagtaactttatttcttatatggataaatcaactaataatggtaaattaggtataactttaaaagtaaatatcttataataattattaattaatttaatacataatagtttataaataaaatatatatatatatatatatatataaataataatatataataatatatatacatataatggaaaatcaaaaaataaaaaagataaggaagggtttatttatttattaataaagaatgtagataaaaactagatggaagttaataatgggatatatatataacagatagagaccgaatggttaggtgccttttttgggtagaggaattagttagttcgattctagcctatctgaaaaagaagtataaggaagtattaattgctcttttagtttaattggttaaaacatattacttctaataatataattaacgttcgactcgttaaaggagcttaaaaagcagtaaaggaatttagttaaatggtataacatcagatttacactcttaagttaatggttcaactccattagttcctattctataaaaagagaaaaaagtatataataatataaaaaagaatttaataaagaaaagagtatgatgtcggctcagattaagcgttatctaaggacataatacatgcgaatagaacgatatataatatataaaagtattatataaagttgtgtaaaggtgagtaaaatattaaaatgtgaactattgtaatatatgaaatatatatgaaaaaaagataaaggataagatccgatgatagtccagttaatatgtggaataggtagtaggagaaattaaaaaggttaacctagccatagatccatagtcaataatgaaagttataatgaccacattgatcttgaataaggtcaatataaaagatgtaatttatcataaggatagattgcatataatacagcagtaaggaatattagacaatgatcgaaagattgatctagttacttagaaagatgaagattataataaaataaaaaaaagaaaataataatgaagaatataaaatcaatgtatatatataagaataatgatgaatatatatatagaagtcttaaccaaaattagtgccagcagttgcggctaaactaaggaggcaaacgttaatcattaatggcttaaaggatccgtagaatgatatatagaaatatatattagagttaaatagaataataatgaaaaattatatagagagatgaaatgcgtggaaaataattagacaaataaacgtgaagataaaattaaaaatttaactgacattgagggatgaaggcatgagtagcaaaacggattagatacccgagtagttcatgcagtaaacgatgaatactataaaatgaaaaagaaataagcgaaagctaaagtattccgccaggagagtatagcttcaaagtagaaatccaagacaatagacggttacagttgtaggcagtggattgtgttttttaattcgataatccccgaaaatcttaccactatttgaatcttattaacataaaagtaaataatgacaaatgttacatcgttgtttaaagtctgtgctttaaggttatgattaacttcataaacagacgaaaatccgtatctataaaaaagaatatagataaaaattaatttaattaaaaaaattaataataaaaggaactacaacaaatcctgatgacttaaatatagtgggctaaagacgcaatacaaaatagatataaaaaataaaataaaataaaaaaaattaaataataaataaaaatggtatatcaaatatgtttatagaaatatatataatgtggattaatctctgaaattcgagattatgaaaaaggaattgctagtaatcataatacataaaattatggtgaacttcctttctgtttcgtactaattactcatcattcgcttgaagtttatctaaatattaaaaatataatatacataatatatgttctataataataatatattatactatattatatactcagttagaaaatgactagtgagaagttgaaatacagttatcgttgaggaatcagcggtgggtggtaaaaattaactaaaattatcatattattcttaatatatataaatatatatatatatataaaggtctatagtttaatggtaaaacaatagccttcaaagctatctttaagagttcaagtctttttagacctgtaaaaataataataatgaaaaagaaataaaaaagccataaataaaatataaaaaataatcaatataaaaaataaaataaaaagagatcataaaaataaaaataaaatgaaaatgaaaaagaaaagaaaaagaaaaggaaaaaatgtatatataatatacaaaaaagaaaaaaaatcaaaagaaatgatagcatatagaaaaagacaaccttatataagtttagtgaatagttatttaatagattcacctcaaccaagttcaataaattactgatataatttaggaagtttattaggattatgtttagtaatacaaatagcatcaggaatattcctagcaatgcattattcatcacatatagaattagcatttgattcagtagaacatataatgagagatgtaaacttaggatgattaataagatatatacacgcaaatggagcatcattcttctttgcatgtatgtatatacatgtaggtaaagcattatactatggttcataccgtaaaccaagagtattagtatgaataataggagtaataatattagtagcaacaatggcaacagcatttatgggttattgccttgtttacgggcaaatgtcacattgaggtgcgacagtaataacaaatttattatcagcaataccatttataggagcagatatagtaccatttatatgaggaggtttctcagtaagtaatccaacaatccaaagattttttgcattacattacttattaccatttgtattagcagcattagtagtattacattttatagctttacatgtacatggatcatcaaatccaataggaataacaggaaatatggatagattaagtatgcacccatactttatatttaaagatgcaataacagtatttgtatttttaatattattatgtttctttgtattcttttctccaaatacccttgggcaccctgataattatataccaggaaatcctctagtaacaccagcgtcaatagtaccagaatgatatttattaccattttatgcaatattacgttcaataccagataaattaggaggagtattagcaatgtttggagcattattaatattattagtattaccaataacagatagaagtttatatagaggtttagcatttaaaccattatcaaaattattcttctgattatttgtatttaactttatattattaggtaacttaggacaattacatgtagaagtaccatttatacaattaggtgtaaatagtacaatattctacttctcatatttcttaataatagtaccagtaatatcaacattagaaaacatattattctatttaggtagaataaataaataaataatatatatataaataaatatatatatatatataaaggaaataagggtaaggggataggaaaaaaacaaaaagaaaagaaatgttagcaatatcaataataatatttgtagtattaacaagtataatagaaaaaaacaacgaatgtaaaaaatgattaaaaagagtatgtttattaagtttaataaatgtattatgaataaatttaagtataaattcaacagagatattagtattaggacattcattatataatagtttattatatatagatagtttaaataattatatgatgaatttaatattaatagtgggaataatatatatgttattattatcatgtaatataacaacaataaaagtattagatcatataatacaagtaaaagaatcattaggattattaatattatttaatatgttaggattagtattattaatattagtaaatgatttaatggtattatttatagtaatagaattacaatcatattcattatatttaataacatcagcatataattcatcaagtaatagtgtaaaaagtggattatattattttatagtaggaagtataggatcatttataatattagatggaacagtatcaatatatgaagagataggattaacaaatatagaattaatatcattatgtataaatcatataaatatgtatgatatattaataatattatttggattatttataaaagtaggattagcaccattttatagttattcaatagtaatatatacattagcaccaacaatagtaacatattatataagtttattacctaaattaagtatattaacattaatattaagtttagtaagtataataaatttagtacatacagatagtagtagtaatataataaatataataagtttcataatattaatatcaatgataataggatcaataggaggagtaaatgtaataagaataaaaacattattagcttatagtagtttattaaatgtaagttatatgttattagcaataatagcaagtaatggatattcatatataggatatttattctatatattacaatattcaataacacatataaatacatttagtataatattattattaccaatatatagtaatataaatttattaatgtcagaaaaaggtgcaaatactaaaaaatatgatgtaatgttaagtaaatattcaccaatagaatatataagtcaattaagattattattaaataaaaatagttacttatgtatagctttatgtatatcattcttctcattaataggaataccacctctaagtggattctatggaaaattattagtatttataagtgcattaggtaatggatatttattcttatcaatattattagtaatagcaagttcaatatcagcttattattatggaagtgtaataaaagaattatgttttgatatattaaataattataatgtatttagttataaagatatatcatcatataaaacatcattattaagtaaaatggaaacagtttatacaacattaaaaaataatatagtaagtaaagatggtaataatatattattaatgaataataatataagttatcaaataagtttaatgacattagtaatagtattaatactatttgaatataataacataataaggggtacatttatagtaactttaaatatgatataatatgttccaagatatatttaattgatttttaatagtagtaggtatattaggtttaatattaataatagtaaactatttattagtagaaagtagtaaaatggatgaaaatgtaggaaatagtacagattatatagaaaaaagtaatcctttcgaatgtggatttgatagttttaaacaaagtaataatccagtacctatcccattcattttaatagctttattattcttaccatttgatttagaagtatcttcaatgttaccttatataatatcaagttatatagtaggtaattatggtttaatattctttatattattcttattaatattagtagtaggttttgtatatgaattaggttcaaatgcaatatcattagttagattaataaatacttcaagtaaatcttcaaaattagatgtttataattatataaaagatagttataaaaaataattctaataaatatttatataaataaaaaaaaaatatatatatatatatatataatgaaaaagtccccgcccggactccgtgcggggcataatattatataataatataatataaatataaatatatgagtatagtaaaaaaaaaaatagaaataaaagtaaaatggaattagtataaaaaaataaaaacaaaatgaaaagaaaagaaagtagagaaaaaaaaaaggaatctaatatatgtataataaattaattaaaaaaataagtccccgcccggactccgtgcggggcataagtaaaaagatacatataaaaaagaattactaaaaagtaatgaaacatcaaataacatttggagattatattaatagatgattatttagtacaaatgctaaagatatagcagtattgtactttatattctcattattctgtggaatattagggtcatttatgtcattagtattaagattagaattagcagcaccaggaaatcaattattaatgggaaatcatcaattatttaacgtaatagtaacagcacatgctgtattaatggtattctttttaataatgcctgtaactatggggttctttgggaattacctagttccattaatgataggagctagtgatatgagttttgctcgtttaaataacataagtttctgattattaccaccagctttagtatgtttaatagctagtgctttaatagaaaatggagcgggaacgggatgaactgtatatcctccattatcaggaatacaatcacatagtggtccatcagtagatttagcaatatttgcattacatttaacatcaatatcatcattattaggagcaataaattttataacaacaatctttaatatgagaacattaggaatgacaatgagtaaattaccattatttgtatgatcagtattatttacagcaatattattagtaatgacattaccagtattatcagcgggaataacattattattaatggatagaaactttaatacatcattctatgaatcagcaggaggaggagatccagtattataccaacatttattctgattctttggtcacccagaagtttatatattaatattaccaggatttggaatagtatcacatgtagtaagtacatatagtaaaaaaccagtatttggaagtataggaatgatatatgccatgggatcaataggatttttaggattattagtatgaagtcaccacatgtacgttgtaggattagatgtagatagtagagcttactttacatcagcaactatggtaatagcagttccaacaggaataaaaatattcagttgattaaataaaagtctgattagtaagactttaataagtaatttgttgatcgacaaagttttattattattattaaaaattaaaagtttattacctgaaacttatatgtcaaataaatataatttatatgaattatttcctagatcaaataaaatatatatgatagagaataatgtatgtaaatcattagtagtatatggaagtaatatagaaaacaatgtaggtaataaaaaatatacaagtatagtaagttatatgataaatttaccaaatagaatattatatatattagtaggtttaatattaagtgatgggtatatagattataagtctttaaaagggaaagaaaaaaagatagataaagatatagttttagtaaattcaagatttagatttaaacagtctatgaaacatatatcatatttattatatgtatatagtttattatcacattattgtgtaagtgtaccaaaaataaaaatagatactataaaagggaaaaaatatttcaatatagaattaataactagaagtttaccagtatttacattattaagacaaaaattttataatggaagagtaaaaataatacctttagatatttatgattatttaacatatgaaggtttagctcatataataatgagtgatggttctcatatgaatggaggaggaatagtactacatttccaaaattttactttaaaagaattaatatatttaataaatgtattaaagataaaatttaatatagatagtactatacataaacatagaactcaatatgctatatatataaaaaaagaatctatggatagattatatttattagtaaaagattatattataccttcaatgagatataaattcaataaataatatattaatatctattttaataataataataaaaataatagacaaattcgggggaaaccttaatattagaaatgaataatattaagacaatcgccgagctaaatcacgtgtaggaaactttcgtgtaaaagtgtagagattagacgtctattaataatctaagtagtatatatatataatataataaataagagatatatatatattatatgattatttaaggtataatccaacagtgtcagtgatgattcttataaaaataactataagagtatataaataataaaatttatatatacattaattaactagctaaaattttaaatgaattttattataatagaatttaatttaataaagatttataaataaaaaaaataaatcattaatctgagatgattataggttaatattgagcaacattatacgggggatcaataagatttacaacaccaatgttatatgcagtagcatttatatttatattcacagtaggaggtttatcaggagtattattatcaaatgcaagtttagatatagcattccacgatacttactacgtaatcggacatttccattatgtattatcattaggagctttatttgcaatatttgcaggatattattactgatcaccaatggtaacaggattatattataataatgtattatcaaaaatacaattctgattattctttataggagcaaatgtaacattcttaccaatgcacttcttaggaatgaacggtatgcctagaagaataccagattatccagatgcatttgcaggatttaatgcaatatgttcatttggatcattattatcaatagtatcattattatactttggatatgtaatatacgatcaattagtaaatggtttagttaataaagatttaagtactaactcattattaaaagatccagacttctttgaaagtaatgaaacatttaaatctaatgaagttaaatcagaatcaatagaattcttattaaactacccacctatgttccatacatttaacacagtagcaatacaatcataggtaaaaaaaaaagtatatatatatatatatatatatatttatataataatataaaataaataaaaatataaatgatagtaaatcattaaaaaagaatataataatattaagggtaatataattataaataaaaaaaagtaaagaaatgtcaatgatattcataaattcaccattagaacaatttaaaataaatacatttatatcattatcatcaccgataatagatttaagtgcaataaatgtaacaacatttagtttatacacaggagtagtagtattaacaataatgttaatatttggattaggattagatcgtaaattagtagtaggatcaaactgattaatagcaatagaaggaacagtagatacaatagtaaatatggtaaaaggacaagtaggaggaacaatatatggaagatatgtaccattaatatatacattatttgtatttatattagtagcaaatttaataggtatgataccatataactttgcaatagcaacaagtatagtatttataatatcaatatcattaagtttatgaataggtttaacaatattaggattatacttacataatatagtattctttagtttatttgtaccagtaggaacaccattagctttagtaccattattagtattaatagaattattatcatactcagcaagagctatatcattaggtttaagattagcagctaatacattatcaggtcatttattaatgagtatattaggaaatttagtaaaaacattaatgggaataagtaaaataacatttataataggtttattaccaatagcaggaatatttgcaatagtaatattagaatttgctatagcatgtatacaagcttatgtatttgcaatattaacatcatcatacttaaaagatagtttattcttacattaattaaaaatataataataaatatatataaaaaacaaaaaaaaatatatatatatatatatattataaataaaaaagtatataataatataaataagatatataataaaataaattgaaaaatgtatgtgtaaattaaataagaaagatgaatttatttatataaaaactactaatataaaatggtaaataaaaatataagagagagatcagattatattgagaccgtaaggaaactgagagtaaagaaccaagggaagtgaaacatctaagtaccttgaggaaaagaaataaacatagattctatgagtattggtgagagaaaatagagaagtataagtaagtagtaggagttaaaatatctacgaaaatgggaaaactaatcctaagactaaataatattagtaagtgtaataagtaccgaaagggaataatataaataagtgtaattgagagcaattataggttaataaaaagaaaattaattgataatgtaccttttgtataatgggttagcaagttataataaatagcgaaaatgaaaagaatttgaaatgaaaatgaaaagaagttatttgttatagacccgaaagtagatgatcttaccgtatacaagtggttaaggtatataataagttttgaatgaattatatattaaacgactgaacaggttaatgttgcaatattatctgaagatatatggtaagtagtgaaagacaaatctgatctacagatagctggttctttgtgaaatatattttagtatagcgttaattaattaataagtgtattaatatggtaaagcaattaataataattggggtattgtagtaatattatcaatattatttaatctcagaataatattaatataaaaattaaacgtcagactgttagtgataagattggcagtctaaagggaaacagcccagatcaaagaaattaaagttccaaataataatttaagtataaataatatttattaatcgtaaaacaataatgggattagtttgacagtaattattctatgatcaacgtgtaacaacgggtttattataaatagaagagataatcttctataaaaggatatgtaaatattctgatcgattaatagatagataataatcggaattaaaaatataactgaaaatttgaataatattattaaaaaaataatagtaatattaaggtaacaaagcatttaatgaagagaatataataataaatttattataaaaaaaagaatataatatataatataaaaatatatatatatataataaaaaaaagaaaaagaaatatcgaattaaatagagaatgctgacatgagtaacgaataagaggtaaaatcctcttcactttatgtattaggttttaataaaaaatcggtccataagatatattctgaaaagaatatattaataggtaataaataaatatatatacgcccatataaaaatatataagattatatatggtacaggaaaaaatatataaataaagataccgtaataaaaccgacacaggtatactaatgaaaaatgaaagtgaataagttaattattctaaatgaactcggcaaaacaaaagctcagacgctagtcaaaaagagtgaataaagtacatgttatgcgactgtttaccaaaaacacagcactttgcaaaaacgaaaagtattagaataaagtgtgaattctgcccaatgtttaataataaagaaatatattaaatgatatatttataaaaattaagtaaatggcggctttatactgagagtcataatgtagcgaaattccttggctactaattatagtcctgcatgaatggagtaacgatgtaacaactgtatctagaataagcttagtgaaattgaattcgctgtgaagatgcagtgtacctaaaggtagacgagaagaccctatgcagctttactatgatttaataagttgttattatttgataaatttttagtatataaagtaatatatagatatacaaatgaaatacttttattttattctgatttatttattaatttaaataaatataaataataactaaattaacacaatattagtagaaatatattatcctaatattataatctaagaaaagatttgtactagttataaattgaaattagataatgttaatgacagctttaaattgatagtttaaatggggcgttgatttcacaaaaaataactgaatatgtccatatacaattaataaaaaatgaaattaatgaattaatcattaaaaatgttaaaaataataagtaataaatttatttattataattttagaaaaacctatgtacagtaaatttgacctgacatcaaataattagataaaaaactaatgtaacattaatataatagtggataactgtgcaataatttaacacctacaagtgaaaattctacgtaagtaaggtataatgaacagatcattttaatagtacaagtgatcgattaacggataaaagttacgctagggataacagtgtaataacatgagagagtagatattgtcaatgttgtttgccacctcgatagaaaaagatgtcgagtataaattgggtgaattgtcaaggaactctaaggtattttttatataaattgaaatactatgacaacttgcagcgaaatattttctatataaaaaatcccctccccttcgtgtgaggatggataaaagggaaataaacgttcaacgactagaaagtgagtaatataacaataatctttccaagagtgcccaaaaaaatatagtaaacttcttatatataataagatattatatatatttaatagtccccgccccccccgcacatagtgcgggggggcagtaataagataaaaagagataataatatcttaattaaggatttagtattagataaaataatatcttcattaaaatataaattattaaactaatatttttaagacatagtctgaacaataatgaaaattattgaaataaaaaattaaaaaatttataaaaacaaaaaatggtcgactcagcctatcctattggtagtataagctaataagggtttgactgttcgtcaattaaaaggctacgtgagttgggtaaaagtattgtgccccccttgatcgtgagatcaaaatgaaacactagctaaaaacggtgaaggctaagttctatgaatatgctaataccgtgggaaattaatatataaatatattgatcccgtaacgacttcaaataaaatttgaaacctatattaaatatatgaaaaaataaataaagtaatatagtagatatatggtttaaggctagctcataaataaataaaacttttaaaaatataatgatatatatataatgaactttatatagtagtaaataactatataattaagtaataattaataataaattaattaaaaataatagccataaaaataataaatgttaaaaaataataaaaaaataatgacaaatgtattagataatagacttcgtgaaaattatgtagcggggtttgtccatggagatggaggtttttcaataggattatatattagaaaaagtaaagctcgtactccatgcggagcagaaaagcaaagtaataaattaaaattgatattagtaccaacttttactttaacacaaaaaaaaagtaatattttattaatggaaagaatattcaaaaaatgaaataatgtaggacattatatgatagattcaaataatataataagatatagagtacgtgatataaaaaatatatcaaaggaaataataccattttttaataaatataatttaagagataataaattattaagttatataaaatttaaatttgtaatagaaaaattaaatagtatagaaaaaaataaaaaatgatttagttatgattattcaaatgaatataatgaattgatgttagatttaattatattaagtactaatatgaatccagatgttaaacctagtaaaacactagaaaaaatatttaataaagatttagttttgggaaatataaaggaaaaagatttaaataggatattaaaaaatgatataagtttaaaaacaatgaatgaatttaatgattatatattaaaaaattatatattaaatgagaattataaaaatcctttaacagtagattttattaatggattatttgatgctgatggatgaataactttaaaattaagtagatcatctcgtaaaaaaataaatatgggatgagaatatggaatagtatcagataaaagaaatgcgaaagtactttttgaaataaaaaaatactttaatactacattaggagcaggaaatataaattacttaaaatcagaaaatacagcaagatatgtagtaactaaaacggattgtttaaataatatatttttaaaaatatatggaataaatgattatctggagttattttataaaaaaaatctaaatataggtccaatagtaaaagataaaaagatttgaataattttaagactttatttattatatatggagaatttaacaagaattgaaacagacttaaatataaaaaatttagtatgatttacaatattaaaatattcttatataataaaacctgatcatttaaaaagtaaagaatcttattttgattatatagatagaatgaatttaaaattaaatttaaatttggatgtaaattcttataaaaaaaggtcaaagtaaaagtcctcgttcgggtttcgtgcgaggcataaaaaaaaaataatatatatatatatcagttttatgaagtaaaaatttatgatgaaggtatagtctaatcatctacgaaagtagatgtaataatgtcaatacgtcgtgagacagtatggtttctatcttctttagggattagttaaaaaaggtatataacttagtacgaaaggattagttatagttaatcaatgattttactgttgtatattaataatatattgaataaatatataaatcatgaaataatcaagaagtaatatgcaggcagttaagttaaattaataaaatttaaatattgaaagcatttcaaatataaaagtaacttttttttaactatataattatatatgtatacaccatatatacatatatatattctgccctcccactacgtgggtggggcgggaacttatattatgttagaataacatatattatagtattatattagagataataggttataatatactaattaatataagtagtttaatttacattctatttatttattatatatcttatttataaagagtgaaaaatatgttataatggcataattggtattgcgtttgttttgtaatcaaaagactttaggttcgagtcctaattataacaaaatattaattaatgaatatatataatataatataaaaaaataatataatataatatataatataatataattttctatttctttaaatacaaagaaatatattaataaggatagagagaaagataagcaaaaaaggtaaataaacatttatataagaagataataggttataataattatataaataaaaaaaggaaaaaagaaatggaaaaatcatttacaataagaaatagaaataatttacaattattcccattccatttagtagcaccatcaccatgaccaataatgatatcattttcattattatcatttatgttaacattagcattaacaatgcatggatatataggatcattctactttttatttttagcagcatcagtagtattagcaacaatattcttatgaactagagatatagtagtagaaggaacatatttaggagatcatacaatagcagtaagaagaggattaaatttaggattcttattatttgtaggatcagaagtatttatatttgtatcattattctgagcatacttccattcagcaatgggaccaacaatagaaataggagcaacatgacctccagtaggaataacatcaataaaaccaacagaattaccattattaaatacaataatattattagcaagtggagcaacagtaacatgagctcatcatgcaatattatcaaaagatagaaatggtacattattaggtttattaataacaacaatattaatagtagtattcgtattatgtcaagtatgtgaatatacatttgcaacatttactatagctgatagtgtttatggttcagtattctatgcagcaacaggtttacattttatacatatgataatgttagctataatgttatcagtatgttatgctagaatgtatttatatcattttacttcaactcaccatgttaacttagaaacaacaatattatacttacatgtattagatataatctgattattcttatatatagtattctattgatgaggatgttaattaatatatatatatatatatatatatataataatatataataatataatatataaatatatataagcgaatttaagtcaattggctagacaatctgttttccacacagaaaatgagggttcgagtctctcaattcgtaaatgcatgatagtgtaattggtcaacataatagcctcatgagctattgattcatgttcgaatcgtgatcgtgcacaaaatgaatgaattattgcttaatggttaaagcatttcactcataatgaaacaatctaagttcgattcttagtaattcaatacaattagattataaatagagagttataaatgaaatttaataataaaaaattaattaattaattaatattaaatggtaaatataataaataaagaaagtcaaataaaaaagaaaaaaaaatgttaataaataaaatatgaaatgatgtaccaacaccatgaggattatttttccaagattcagcaacaccaaatatggaagggataatagaattacataataatatattattctacttatgtataatattaggattagtatcatatatattcttaaatgtaataacagtatataataattcaaaaatagcatataaatatatgaaccatggacaatttatagaaatagtatgaacaacattcccagctgtaatattattaataatagcattcccaagtttcatattattatatatatgtgatgaagtaatagcaccagcaatgactataaaagctataggattacaatgatattgaaaatatgaatattcagatttcattaatgaaaaaggtgaaacaatagaatttgaatcatatatagtaccagaagatctattagaagaaggtcaattacgtatgttagatgtagatgcttcagtagtatgtccagtagatactcatataagatttatagtaacatcagctgatgtaatacatgatttctgtataccttcattaggagttaaagtagatgcagcaccaggtcgtttaaaccaaacatcagctttaatacaaagagaaggagtttattatggacaatgttcagaattatgtggagtaatgcactcagctatgcctataaaaatagaagcagtttcattaggagaattcttatcatgaatagatgaacaataaatagtaatctataaatatatataaatatatatatatatatatattttaatcatatatattttattaaatatgaatatagatattcttataattaataataaataataaaaatagtccccgccccccccgcacatagtgcggggggggcagtaataaattagttagttaattagttataaaaattattatataataataaatatattatataaatgaattatatatataagatcttttggtctaatggatatgacattgattcttcatatcaataatatcggttcgattccggtaaagattataagtataaaagaggtgaaaaggatgagagttaattaataaatgagaatgaagttaattaaaagtaattaagaaagtaatatatatataaaaaaataagaagttataaaagatatatataaaaaggaatagaaatggaattaattttattagtattaggttcaataggattaaatataatagatatctatataatgatagagatattaataatggggtgtacagtaaatagtatatgaataagtaatataaataatgatatgataggattattgtatagtttaatacaaataataatagcaggaatagaatcagctataggattatcaatattagtaagttttaataaaataaggggatcagatgacatattaagaagcttataatatgataaatataatagtattttcaacattaataggttctttaataagtggattcttaggtagatatataggaatattatgaagtcgtataatagtatgtacatcagtaatattgtcattaataagtacatatatattatattatgatgtaatggtattagataatgaatatagaaatataataatgagttgaataagtgtagattatttaaatatagattgaggatttttaatagataaagtatcagtatcagtattaataccagtagtaacaatatcaagtttagtacatatatatgcagtagtatatatgtcacatgatccacatcaacaaagattctttagttatttatcatttttcacatttggaatgatagtattagtaacaggagataatttattaatattattcttaggatgagaattaataggggtagcatcatatttattaatatcattctgatttacacgtatatcagcaggaaaatctggattaaattcattattattaaatagatttggtgatactttttttgtaataggattaggattaacagtatatttagtaggaagtttaaactttgatactttatttagtttaaatggatatttatcaacagatatgttaacaataatattaatatgtatgttaataggttgtgcttcaaaaagtgtacaatttggattacatacatgattattaaatagtatggagggacctacaccagtatcatcattattacatgcagcttgtttagttatagcaggggtatatttattagtaagatgttcatatatagtagaatatagtccaatagctttaatattaatattagtattaggaggtataacaacattagtatcaggattaatagcagtagtatcaaatgatataaaaaaaataatagcattatcaactatgagtcaattggctcgaaaatatgtatcaaataaagtccccgcccggactccgtgtggggcagaaattaataaaaatatattaaaaaatttgagaaatatttgaaatcaaactatatgcgttgaaatcataaaatataaatatgagaattcgcagataaccaaaactcgttataaaaataacaatgtaaagatatttaaatcatcatccttattgataaggtttttcaaattgaagttaaaagaatgaaaatatgtttatataagcaagttagtaggaatctcagaggccatacgtttgatgttttataatatgtataatatattaattataaataaagaagaaacttataaagagaagaatagatataatagaactttaaaagcgataaatgaattaaaagaatctttatatttagaaaatgataaggattataatgaatgattatcaggagtaatagatggagatggatatttaaatgtatcaaaaggaggaacagtaagattaataataacaatggaggaaagagataaaatgttattagaagatataaaatccaaattagggggatcaatatataaagtaagtaatagtaaagcttataaatataaattatcaaatttaaaaggtttaatgaatttattattaagaataaatggattaataagaaacccaacaaggatgttacaattatcaaaagtatgtaagcattatgggttagaattaaaaatgccaaaagaattaacaaaagaaaatggatgatttagtggattaatagatagtgatggttcaatatatattaatgaaaaaataaaaagggtagagataacagtatctcaaaaaaatatatatatactagatatattacaaaaagtatatggaggaaaaatataccctcattcatctaaaaaagaagcatttaaatatgaaatatatagaaaattagaagtaaaaaatttagttgataattattttaataaatatccattaagatcggcaaaaaaatatagattaaaattaatacatgaagcgtataataaattaagtaatttagatttaaataatccattaatattaaaagaatgaatagaatttaaagataagtgagataattataaaaaataagtaataaaaattcttgctgaatatttaatcagtacagaataagtttataaatatttttttttataaaaagtttaatttagatataaaacatatatatatatattaatataaaataaagaaatggtccaagtattttttaaaaagaaaggaataaaaaagattaagaaatataagcaagtagggataatgatgttaggagtaggtatatcagcttataatttagctatatatcatttaatatgtcatagtttttttaaagctttattatttatgtcagctggtgcaataatacatgcagttatgaatgaatatcaagatatacgtacatatggaggattccataaattcttaccattatcatatatctgtatatttatagcatcattatcattaatggcattaccaggattaacaggatattactcaaaagatataataatagaatcattatatggttcatatacatttacaggatatataatatattgatttgcaatagcatcagcaacattaacatcaatatattcagtaagattagtttattatgtattcttaaatacaccaaataatccaaaatatgtatatatgcatttaaatgaaaatccaatattaatgtatatacctatgataatattagcattatttagtatatttgtaggatatttagctaaagatttatacttaggattaggagctacaatatataataatatatttatacatccaaataatttaataataatagatactgaatttagtttaagttcattaataaaattattaccattaattacatctataatattatcaacaatattattagtaatgtatgaattattttatgataaattatttatttataataatacatgattaatgaaagtatataatttctttaaccaaaaattatattatgatcaaatattaaataattatggatttagatcttgattatatatctcatatttattaaatacttatgtagataaaggtgtattaatattcttaggtccttatggattgtcagctttaaatttaaaaatatcaaatgctataaataaattagtattctttaatttaggtttaatattagaattaatattctttagtatatttgtatttatattctttaatacttatacttacttatatataataatagctgtaatagtatttatatttatttaagtaatcatatgtataattattttaattaaattttttaatatatatatatatatatatatatatacatataatatataataatagatatatataaaaatataatatctactctagatatattaataaaagataagataataaattaatatataattgtaaataatagtaaatcgattttaatgtgtaaatgaaatgccacaattagtaccattctttttcttaaacactttattttatggatatatagcattatttgtgatattagtattagtatcatcaataatattaccatatatattaaaagttaatataataagaaatataatcgtaagattataatataatcataagattatagtatatatatatttatatatatataaagtctataatttaagggtaaaatatttccttgataaggaaaaattagatgttcaaatcatcttggacttaaaaatgtttctatagcttaacctggttaaagcaataaattgaagctttattgataaaagttcaaatctttttggaaacagtaaaaattataataatgaaagattataaaacataaaaaaaatgaaaaatttatctaaaaaaagaaagtaggtaaaaaataaattgaaaataacatgcaattagtattagcaggtaaatatataggagcaggaatagctacaataggattaacaggagccggaataggaatagcaatagtattcgcagccttaataaatggaacatcaagaaacccaggattaagaaacacattattcccatttgctatactagggttcgccttatcagaagctacaggattattctgtttaatgatatcattcttattattatacggagtttaattaaaaaacaaatatatatatatatatatataaataataatgaatttaataaaagattttgtaaataagttaataattaacatataatataaaaaatttaaaagtatatactggaaaaggtgaaaaaaaaagatagttcaacaataagtttttcaaaaaaggaggatgtattaaaattaatcaatatattttaaaataatcaaaaattattaacttaaaaaggtatgcgtgatttacaaataatgaaggatttattagagtatttagataaaactaaaaatgaacagtacaatatgaattgattatctcgaggtgaattattaataaaagatttaaatacatataataatttagaatctaatgaaagtatattaaattatataaaaagtaatataaataaagattatatatcataatttatagaagcagaaggatcattaatattacataagaataataaggattataaatatgtaagttttgaaataacttaataaaaaaaagaatatatatattatatgcaattgtttcaactttaatggatagtgataatgcttcttcagtgacaactaaggaacaaaaaggcaaaacaatttataatgatagtaattcaaagcggatgaccgtgaataacaaacggggcatcgtattttatgaagatttgtcggggcagcaatcctatcataccgggatgagttcaacgttgtccaagagtttcaaagtattgaaacaaatggaagtcccgttggataacatgcgctattatcactacaatgccaaaaataattccgttgtttaccgtagttacgtcgaaggctttcctatctttaatcaaaccgagtacggaacggttgaagttcagatgactggtgcgagaacaaaagaaattgatttttcgttatacagtttacaaattcctgtacccacgggtaaggaacgcacgattttaccatcgacgcaaactgttttggatcgcttagaagcagttggttacaaattaagtgatattaagaacattgaaattggttatcaatggactgcaaatccatccagtgatttagtggtaaacctaacaccaacttggtatgtgaactacaagaatcaatggatttcttatcaaaagttgattgaacaacaaccataaggggatgaaaacgcatggatttcaaaagaattgagttaatatttttaacagcattcgcggcactggatatctttttagtcatctcctttttccaaaataattctgatgttcattcaacttcacagggagcgagtcataacgcgacaattttgaaagaaatgcgcgatgattccatttctttttcaaagccgtctaacaaaaaaggtcaaggctattatatttcaacccagacctctggaaataaacggctaaaggaaaaaatggaatctttgactgcccaatcagctaaaatggttaacggtgaaataattagtacgtttaacacaccgctaactttgaatacaaaaagtccagaaaaaacattgaatcaaattgtgaacgacagtaatcagattgtgaatgggaaacattatcagtatgatgccaaaacttctacaggtagtcagattatctatacgcaaatggtttcggggcaacgaattttctccagatcaggacaaattcgatttaagattaacagtggtggtcaagtggttggctacacacaggggtatttgacagatgctaatccattgcgggaaaaacaagatacgataagtcaggaacgtgcaattatttggctttaccagtataatgaggtgcctaatgagtctgttattaaatgggctcgtttaggatatacaagattgttgagtatccaaaaaggatcagtttatgtgccaacgtggtacattgctgtccatggtaaaagtagtgcgacccttcaatattatcgaatcagtgcatttacgggtgtaattatgaagtataatacacaggtgcaatcttcatctagtagcagttcaagtactgcagagtctagtagcgaagatgatagtagtctgttgaaccaagcggtttctagttcgaaacgagccgtggaatcaagtacacaggcaagtgttcaagctacgaccagaagagcctatagcagcagtagtacatcaagttcaagtaccaatgcagtttcaacaagttcgagtgaatcaacaagcagccaagtctcgagcagtagctcagcttcatctgaagttcattagacacttaatttaagttaaatttagttcgaaggggtaaggaaatacatgagtgacgacgatatgaagattagtgttttagcaagtggtagtactgggaatgtgacctatattgaaactcccaaacataagatgttagtggacgccggattaagcgggaaaaaaattgaaggtttaatgaacagtattggccgagaccttgcggatgtcgattcacttttcattacccatgaacatacggaccacattcaaggggctggtgttttggcccgccgatataacctcgatttatatgctaatcagggaacatggcgagctatagagcccaaaattggtcctatcccagaagaaaagaaaaacattttcgaagttggcaaaacgaagtcctttggagatattgatgtggaaagctttgcagtttcgcatgatgcagcagaacctcaattttatgagtttcatcataatgggaaaacctttgtgattttaactgataccggttatgtttcagagcgggtggaaggccaaattgaaaatgcggatgcctacttgttcgaagtgaaccacgatgtagaaatgctgcgaatgggtggctatccctggccactgaaacaacggattttaagtgatcatgggcatttatctaatgaagctggcgcaaatgcgttgatggatgtcatgggatacaacacaaaaaagatttttcttgggcatttaagtttgcacaataatatgaaggaacttgcacacttaaccgtggcctccatgatgaaaaacaaagatttagccgttggtcatgactttcagctttttgacacagatcatacaaaggcaactaaactgacagcaatttagtgaaaaatataaaaatcattcatattttcatcacaatttattgttatgctgaaagcagttacaattaataaggcgaagggggtttggcgatcatttgatcgcatatagctatgtttaaaaacaagaatttatgggcagttttcattacagcgctagttgcaggtttgattggtggtggaattgcgtttggggcagttaattactttagtaatcgacaagcagaaaacgcgacagccgtcccaagtggttcgaatagttcgggctcaaccaaggtcagcaacgtgaaggttaatgtgagtgggcagtctgaaaaggcttatagcagcattaagaatgctgtggttaccgtcattaatctgaagaaggaaagttcaaattcaagtaacagtttatatggttcgatttttggagaatcgtcttcaagttcgtcaagttcctcaagctcaagtaagcttgagacatacgcagaaggttcaggagtcatttacaaaaagagcggaaatgcggcttacgtagtgacaaacaaccatgttatttcgggttcaaacgccgttgaaataattatgagtaatggtaagaaagtttcagctaaggttgtaggtaaggattccgtcaccgatttagcagttttgaaaattaactcttctgtagtgacaaccgttgccagctttggtaactcgaataacattaaagttggtgaaacggcgctagcgattggttcaccacttggttcagattatgctacttccttaacacaaggaatcatttctgcgaagaaacgaaccgtttcaacgacgaatgaatctggtcaagaaactggggaagctacagttattcaaacagatgccgcaatcaactctggtaactcaggtggtcctttgatcaacttagcaggtcaggtaattggcattaactccatgaaattatcaagcagttcatctggtacaagtgttgaaggaatgggttttgcaattccatctaatgaagtggttacgattattaatcagttaattagtaaaggtaagattgttcggccagcgttaggagcttctttgattgatttaacagacattacgtctagtcaacagaagtcaatcctcaagctaccatcaagtgtcaatgaaggcgctgtgatctatcaaacgtatgcaggctcaccagcacgtacagcaggcttgaagaagtatgatgtcgtcacgaaattggatggcacaaagattaccagtgtggcaaccttgagggataaactttacaaacttaagattggcgataaagtgaaaattggttggtatcatggtagcacttataagacagccaccattcacttaacagaaaccacaacgacactaagttcacaggcaaaataaattatgaatattagaaaagacgtcaagttaggcttggcgtcttttttttgtggaaaacaaggccgaatcaggccataaggttaagagagatcgcgtgtttctattcttgtctttaattggctagtgtaatccccaaaagaaaattactaactacttcagatggatgtatctatgcgttgttttttattacggacaaatagtgtagaattatacacaggaaatgtatataaatggctgaactgggcgttttataacaagtttgaattacttttgaaaatccactttatttttggagtaaattgtggttccgaatgattttaaatattctaaagtttttcttaaggaaagacgggaatttatcagaagaaaaacgaacattgcccccatcaataattatggattgttcagatcaaaaataagctgtgaaaaacaattgtggacaactgtggataactttgtgaataactaaaatgacattttgaagcgatgacctaaatcaggttggtataagtaatgaaatgggtttaaaagttatccacaggttgggacggaaactgtggactaaatttgtttcacaaaattatgaacgccacaaatgcagatatatcagcgtttctagcctgtggatacgaacatgtgttactgttgaaaacagtggataactaaattttatgttgacaagttggggatagctcatgttgtggtggtggaaaaatgacccctatatatgggaatcttattcaccagcctgtggataactttgtgaataacttgtgtaaaggagtatttttatgaacatcaagtttattgttgtgggaaaactcaaagagaagtattttaaacagggaattgccgaatatgcaaaaagactcagtaaattctgcaagtttagcatcgtcgaagttcccgatgagaaggctccggaatctctaagtgacgcagagatggctgatgtgaaggaaaaagaaggagaacgaattctaaataagatcaaagaacgtgagtatgtgtacagtttggagatactaggtaaagaacgttcgtcagaagaatttgctaaggagatcgatcagttggcaacgtacggtcactctgatctcacatttgtgattggtgggtcactcggattgagtcctgaagtgatcaaacgagcaaatgcacacatctcgtttggtcggtttacattgccacatcagctgatgcggttagtgttagtggagcaagtttaccgtgcgtttatgattaatgcaggaagtccgtatcataaataaaattgcgtgcaaaaaggcaattaattaatgaagcccatcgtagcggagaattaatgtttatactgagatggaaaaaccatactatctgaaactatgtttttccaggctagtgttttgtacaatagttgtttgtcataattcattttttctttgtcttaattacgtttggcttactatttagttagtaagtgggactttttcaataaattttcgttatgtgttggcatacggtagcctttaatgttgcgtactgattttgtgaatgataatcaaaggagcatgttgatgattactactgatttagataaattaatcaaacttgcaagtgataacaagaatattattgccattggtacagaaggtgcgtcaaatgatagcacacaaattagcgatgagtggacagatctagatgtcacactttttgtacgtgaaccagcgcgcgaagatggttggtggtggctccaacagttaggcgagccaacgattgttcaatttattgaaacacaggatttgtttggtccacatagtggtaggtggttttcatggctcacacgctatactggcacacgacgcattgattttaaaatgacatcggttcaggcagaagctgcctatttgagtaatgacacactaaacacaattgtttggcgccaaaataaggggcgagtcccaccgcgcaaaactaatgctcagtcacattttattccgttacccgatcaagacagttttcaagaacatgtgcgagaattttattggtgtgccggcaatgtagttaaaggcttggcacggcaaaatctagtgtatgctaacgagcaatttaatcgatatgttcgtccagaactactaactttactggaaatgcgagcaaccatgcaacaaaatggacgatttgatgctggtgtgacgggaaagtttatcgagccaacgttaagtgcagttgaaaaaacacaattatctgcaacttatcagcaaacctcgttgccggaaactaaagcaagtttgcgtaaagtactgcaattatatcgcggcgtaagtgagcaaatcagtggtaactataattttgacttaccgaaaacaatcacaaaagtttatcaacaattcaatatgtggttaagtgcttaatttggaggtttgataatgactgacatataaatgatgagtcggcagtaagtgatccgtgatctgtcgtagcatagaagacccagaatccgccaataattatcgtacattaaggcaaacgaagagctttattcgctggtctttaacaaatgaactggacgaaaatattgccgtttttgtggatcgctttagaaaagcgatgtttgaataaactataaaagaaggtaaatcgcatgattacataccgattatttaggccagaggatgctaatgatgttgccaaagtgattgctgaaacactgagagtttccaatcgaaaagattattcgcaggaatacattgaagccgatattaaacgtatgaatgcaaaattttttataaataaagcaaaacaaacacatttttatgtatttcttgatgcagatcgaattattggtactggagctattgggtcatattggggaagtactaaggaatacagtttgtttgatatttttattttgcctaattttcagcatcgagggattggtcgtctgattattgaaactttggaaaaagacagctattttctgaaggcaacgcgggttgaaatcccagcctctattactgcactacctttttatcaacacatgaattataggtttaaagatggacagcgcaagcccgataaggaacagctttatcgattagagaaatttccaaaaattgattaaattatagaaaacaaaatgacacgacttcaagcgaagcacttagtcgtgtcattttttgattccggtttttattaatttgtttaaactgacccgtactttaccccaaaaatgctgcatagccagatactgtcggcgtgcatgtgccatctttttatatctaactggattctttttgtaaaactcttgatggaagttttcggcaggccaaaatttggtggcaggtaaaatttcagttacaatcggatgtttatatttcccagatgcccttaatttttgtttggaagcttccgcaatttttcgttgctgagcgctttgaacgaaaataattgggcggtattcctcaccgcgatcgttaatctggcccatattgtcagtagggtctgtaatttgccaataaagggccaccagttcattatacttaataattcgggtatcaaagacaatttccactgcttcaacgtggccggtttgttggcccactacttgttcgtaggttggcttaatgacgtgtcccccggtgtagccagataaaacggaaacaatgccaggccgcgtctcaaaaggctccaccatgcaccaaaaacagccaccggcgaatatggcccgttcatagtaaggattggatagattttgatgttttgcgacatcaaacgtgggtgatttttctgcatcatcagttatttttgcataaaaatccgccacatcaggagtcaggttatcacgccaagctaaagggcgcagcgcaaattctagttggtcaagttctgtgttgaaatgtgcgcctttttcgacagcgtttttcattgtgagcaattgagttcgttcccagactctggttgcggggtttaaaattaggttataaatatcgcgcatagttgtttgttcatcgaccttcattttgcttcctcctcccaacttttcaaatgcattatgcaggaattgtagggagattgcacctattttgattttcgttgaaaactcagaatttaatgaattgcataaaaaggtgttagctgtatttaactcagttagcacctaatttttaaattaagaacaagaaaagatcgttcctaaaagaacgatctttattgtgggacttattaatttgaattgatgagaaggaaatttactttaatataactttgacaacttcttcatcagtaccaacctggcgggcaaggccgtcaaacttcatataacctacagcaggcatatttgtaatgatgacaatcattgttgtacccttgccagagtgattgatagcttgtaggtcagcagtagcaagtaaatcaccatgacgaaccttttgaccttcagaaacgtttactgtaaaaggttctcccttaagttcaacggtatctaatcccatgtgaaccaagatttctaagccatcatcggttttaattccgatcgcgtgtttagtagggaaaacggtcatgatctcaccatcaacaggtgaaacaactttaccatctgaaggttcaacagcatagccatcacctagcatcttttgagagaaggttggatctttcacatcttcaattgcaagtaattgaccagcggttggagtatagaaggtgtcaactgcaccagaattaacatccgcacttgtaacaggttcaggagttggtgcagctgtagtagtaatttttcctactggagcgccttctttatcaagtttggttaacgcatcagcgacaaattgaacttcagttccaattacaatttgaagattggacttatctagaacgttgataccaatagcaccagcccctttaatagcgcctttattaattgtatcggtatcttttaattgcaaacgaagacgggttgtacaattatcgatagcagtgatgttatctttaccaccaatagctgcataaatctttttggcttgaatgctgtatttatcatcactatcatcggtatcgattgcgacatcgacaccttcggctgcatccgcttcgataggttcacgaccgggagtcattaaattgaattttttgattgcaaaatcaaatccaaagtagtaaataacagccatgacaagaccttgaacgattagcatgtagggcatgttagcaatcggcatgcgtgaacttaagacgaaatcgactaagccagcgctaaacgtaaacccggcagtccaatgcataaatgctgcaaaggctaaggataaaccagtaaaaacggcatgaattacgtataaaggccatgcaacaaacatgaatgagaattccaatggctcagttacaccagtgaagaatgccgcgaaggcgccagccatcatcaatgaagctgtttcttttttacgttcaggacgggcgttacgataaatcgccagggcaccggctgggagtccaaacatcataacagggaagaaaccacccatgtacataccggtaacccctttaaccccctggttagcccagaatttaccaatatcattaattccggcaacgttgaaccagaatactgagtttaaagcttgatgtaaaccagttggaatcaataaacgattgaaaaatccatataatccagcaccaacagcacctaaaccaacgaagaatttaccaaaagcaactagagcttcgtatactggtggccaaacgaataataatagcactgtaacaaataacataactaaagcggacataattggaactagtcgtttgccgctaaagaatgataaggccatcggtaatttagtttcgtggaatcggttgtaaagtgaggctgcaattagtccagcaataataccgataaagacattaccactaagggcactaaaggatggatctacttgagttaccttaatgttttttaataaggcaactgaagctggtgctaaaacagagacagggacaaaataagcaacaacaccagctaaagcggcggcaccatctttgtcctttgacataccaagtgcaagaccaactgcgaataaaagcgcaagttgaccaagaatggcattaccaccggcttgcaagaattgcgccacggcccattttgcaggtaaccagtgaccaataccgactaataatgcggcggcaggtaaaacagcaacgggcagttgtaaagaacgacccatgcgttgaagatatgatttcatatagaatactcctccttttggaaagtgaaaaaagttataaatgcataacgcgttttccataataacgcctaaacaagcgcttacacaaccccgttactgttgaaattgactgatattacatgtggtctataccgattaaaaagaacacatgagtcacttcatgagggtttatattttattggtataaaatttgaaaaattaccttattggggcttaaatactcaaatgatttaaattttttgaaattattttgaaagcatttcaatttatgctgtgggttcatttcagtactttaagtcagcttgcgatataatagatttaacaaagacatttaagagaacaaggagaatatatgatatttactggaattatgatcgttatctttattgccctgggagtggtttggtatgtgcttcaaaaacgaattacggcactaaaaaagcagttcacacttgagcaaattactgatgtgatgaccaaagataaaagtgtggttaaaacgataaaacaggctcgtgttttgcagggcatttcctttatcgctgttttacttattttgtggacaatttttgagaattatccaaacagctattatctggttttgctgaatgtgatgcaactcacgacgactgctcggcaatatttcttgtacctagcttggcagcgatgtgcattcttaattaacggaaaataagacaagcgcaattaacgattttggaaataacccaaaacctagttaactgcacttgtttaattatagatatttattactcaactcgtttgattttgcccactgcagtgacagatataacaaaatcagcgaccatgtcggcgatctcaggaattgtctgttgtgatgaaaaatgtttcacgtgaaaatatatatacaaaaaacttgcagaaattgactgcaagtttttttgtgattatttagttcgtttagctaaacgatttaatacagctagtgatgccgcacgataaatccgtgggtaggctcggacaatgtgcacgatcgcgcggtctccaaatgaacggaaataacggtgtttcggtttcgagtcggtcgctgctgcatagaagactttagctaagtcagctgaagttgccccactttgaccttcaaatgagccaaaactcttagctaatgaattaacgaagggtaagtaagcagaatctggcttgagatttttgcgaatattgtccatggtgattgcagaccaagatgattgggtgccaccgggttgaacaattactgatcgaattccaaattgttgaacttcaacatctaaggtgtcactccattgttgtaaagctgctttagttgcgtgatagtaagcgtttagtgggatataaaggtcaccaccgattgatgaaatattgacaattcggccagagttttgtgcacgcatagttggcaaacttagcttagttaattcagctgcgccaaagaaattagtctcgaattgttttcggacattttcaattgaaacatcttcaacaggaccaccttcactgtaacccgcattattaataagcacgtctagtctttgctgttctgataaaatggtttgaataaaattgtgattagactctgaatccgtgacgtccagtttgatggcatgaatgttggcgctagttgggatcttttcaactcgacgggcaccaccataaaccacccagcctttttcagcaaatagttgtacagctgctttgcccatcccactactggcacttgtaattgcgattacttttttcatgcgatattatccttcttcctttgaatatgttactgttgtaacagttagtaattgaagaaagtgtaccgccaattttaagtcattacaatcacttcagagccagaagtgacaaaaggagtaaacatgtcaatgaccaaacgatcaaacgaaacggaagcctacatattgggcgcattggagcgtttattaaagaagaaagcatttgcggaaatctcaatcacggaattagcaaaaacagccggtgtctcacggatgactttttatcgatactatcaaaacccgaccgaaatattgactcacgaaatgagcaggataatgaccgaattaacaactaaagttgattttgatgccatgattccccatgagggcttagtttatatcatgcgatttcttaaagccaatggcgattttatcaaagtgttagttgcggccaatgaacaggatatgttgcgtgatagtattgccaaaactttggtacaattatcccatcacaagggacagctccaagatctgaattctcgtgaaattgcctactatgcgcgctaccattctacaggtttaacgagcgtaattgtcgactggattaccaaagctggaccagagacgccagaagaattggcaacgtttttggaacggattggtgagggagccgaaacttagcagattataaaaaattgggccgccccatcaagggtagtccgattttatcattatttgacataagtactgcagaaatctaatgcaccactaaatttattgtaaataacaccatgcaaggatgatttcactaataaacgcgaacggctttcgtatagcggtgtaaccgcctgatctttgacagctgttttggctgcgtccacaagatcttgataacgtttagtaggattcaaagcatcctttccatcggcagcattcatggcattgtcataggttttactttgataatggcccatgttggagttgctggtagacgtcaaaatggtcaaagcttgcgtcggatcagcaaaatccatgccccaactagttaaattaagctggaaatctccttgagagacttttgttaacattgaagggaatggcatagtgcgcacgttgaccttcaagccatttaaatgattcatcaactggccttgaatgaaagtagctgcatgttggctcgtatcatcgttggcgcaagtgattgttagagttaattgctgttttcctaattgtttttgtgcagttttatatagagtttttgctttggcaatgttgtaagccatagagctcgaaatgtaagcatcgtcggcaaaatctttacctgtctgggggttcttcaacatattgtgcaccccaaacgtcttggccgaggtagagccattttcaagaattttatccactaattgctgacgattaatagtgagtgaaattgcggtgcgtagatcttttttggccgctgttttatctttttcgttatactgaatgaaaccaactcggccggaggacaaagtctttaattctggattgtccttgttttggacattttcttcgccggctaaagtaaccatagccagcttattggcttggtacaaattgtaagccgttgaagtggccttgattacctgataattgattttagcgagctttacaattttatgatctctgtaagttgggttcttgaccaaactccaagtatcattagttccgttccagcctttcaaaacgaatggcccattgtagatcgtttttttagcggtcatgccgtatttagaaccatatttttcaacggctttttggctaattggatagaaagttgtgcctgataaaagcttcttgaagtacggaatgggtttgcttaaatggacctttagctgatatttactagttgcagtcacacccaatgtggcaggggactttttaccaaccataatggcgctggcatttttgaaattggcaaacaaataagtgaattcagatttagttttaggatctagcgtccgtctccaagaataaacaaaatcgttggctgtgactttttcaccgtcactccaccggccattgtggcgtaaattaatagtatatgttttaccatttttggaaacggtggttttggttgctaatgcattgaccggattactatttttgtttaatcggtaaaggccttcatcgacttgactgagttgactactagaaacgccgtcggttatttttgaagcgtctaaactggtaagattagtggtttcgtataaattgattttttgtgcgggtgctgcctgagcttgtttagaattggcatgaatgccgaaactgacgccgccgatcagaatgatacctgcaataagtaatgcctttttgtttgtaaaaatactcatgattgatttcctccaaatatgttgaataatttgtcttgaaattgatcaatgagcgttgccatcgttgtatttccatgtgtttcaccccgtttgagaaatcaaaaaaccgtccttaacagccaatgtgttaaggacggtttttcaccgcggtgccacctcaattgggttcattttagattcgcgaaaagtctaaagatgcacccctactttacagagaacgaacattctcctgacaactgacgtatgtcatgacgtcttttcgtactttcgaaatttcggaaaagccctcggtggtccatttaattacttgcgttcggtcatactctcagcgacgatgactctctgtgcgtgcacagtaatcttgatctccacctcatcggtttttaaggacgattttaagttgccattatcatacagcgggtgatgggaaggtgtcaactagaaaatttactataagacaaattctaattttaaaaaatttcttattgaaattagagtgtcgccaaaccgtaccaaatttacttaaaattattccagtttataaatacccttttaagatctgcatcagttatatattgttttaaaaagttaaattcattagttataaaatgatcatcatgcataactaacacggtaatatcaatggatcgctttaaaagtgctaccccttcttctttctcattttgcatacactcaaccaattctacaagagaaaaataagtgttctagttattataatattgatttcctagtatctgatgacgcataattagaagatggtaaaaatgggagcgtttaagtaaataggcttcgagtataaattttgtaatcttttgtttcgtgttctgcatggatatttttgggggagtagaaccatgaaaagctataagaatgataaagctattaaacggttaactaatgtaattaaaaagcatattaagttcagtttgatgttattaataatcatgctagttttgtttgctattatagggatgtacgttcataacagtcaggaaaaagtcgctagcaaatatcaacaaacaaatattccgacgttatttttacatggatttggcagcagctatcatgcggaacaacacatggttagagcagctaaaagtgctcatgcaacaaatggggtcattcgcgcagaagtgtctaaaactggaaaagtcactttagtcggacatttccgaaaaaaagttatcaatccaattgtgatggtaaattatcaaaataatcacgagaaaagctatcgaactgacggcaagtggttacgaaacattttaaataagattcaacaaacctatcatttcaaaaaattcaatatcgtttctcactccgttggtaacgaagcagtaatgtactatatggctgattttgctccaaaacataaaggattacctcaactcaataaggaagtaaatattgccggccatttcgcaggtattcgtggatatgatgcaattaaacacaactcgataaatgtacaggggaaaccaaaacggatgattgcaacatatcgttcgttactgaagttgcgaaaaacctaccctaaaaatgtttcagttttaaatatttatggaaatattggtgatcatagtgatggtagagtgcagaattactcctcaaaatcattaaaatatcttgttggaagccgtgctaaatcatatcaggaattagaaattaagggttcacaagcgcaacatagcaaattacattcaaatcctaaagttgaccagacactattgaaatttctatgggaaaaataagtgaagtaattttttgccaaatcaagggggtattaccatgaaacacattgtagccgggatcgtcgcccacgttgatgcggggaaaaccacgctttcagaagccatgttgtaccgcacaggcgaactacgaaaacttgggcgggtggacaatggggatgcctttcttgataccgatgacctcgagaaaaaacacggaatcacgattttttcacaccaggctagtcttcagtatcacaagctcgaacttactttattggatacaccgggacatgtggattttgccgcacaaacggaacaagttttaagtgtactggattacgccattctcgtcatttctgcaactgatggaattcaaggatacacacggacactttggcgactgctcgaacgttatcatgtgccaactttcatttttgtaaataagatggatgccaacggtgccgatcgcaatgcggtgcttgatcagctacagagcgtgttttcggtgggatgtattgcgtttaattcaagtgctgacaacacagatatttcagaagaaattagtgaagaaattgcaatgtgtgatgatgaggttcttgaaagctttttggattcaggacaccttgaagacgatacggtccgtcggctaattaaacaacgaaaggtctttccttgttattttggtgctgtgctcaaattaaccggcgttgatcaagttttagcgggtcttgaccgttggactagtgaaacaaaatatccccaagaatttggagcacgagttttcaaaatttctcatgatgaaaagggtgaacggttaacttggattcgcatgactggtggtattctacatacaaaagatgttttagtagatgataaaaaggccaatcaattacgagtttacaatggtgataaatttacaggcccacaacaagttttggctggtggtgtttgtgcggtcacggggttgacgggaacttatccaggtcagggacttggaaatcaacacgatggtgataatccgacaattcaaccggttttaaactatgcattggatcctaaaaacaatgatattcatacgtgtttaacagctttacggcagctcgaagatgaagatccgcaactgcacgtttcctggtccagccatcttcaagaaattcggattcaaattatgggtgaaatccagttagaaatattgcagcaaattttgcttgaacggtttaatttggacgttggttttggagaagggagcattttataccaggaaaccattaccaaacctgtggaaggagttggccattttgagccactgcggcattatgcggaggttcatttgttattggagccggcgccaaccggaagtgggctgacgtttgcgacagattgtagcttagatgtgcttggtaaaaattggcagcatcaggtattagctaacctccatgccaaagagcacctaggtgttttgacgggagccccaattacggatatgaaaatcacgcttgtgggcggcagagcaagcaacgttcattcggtcggtggtgatttcaaagaggccacttggcgggcagtcagacaaggcttgatgatgttgaaacaacgtgatgactgtcaattattggagccgtggtatcaatttcgattagaagttggcaaagatcaagttggacgggcgatgactgatatccaacgcatgaatggcagttttgaaacaccagaaatggctactggagataacgatccgaatagcgaaatgaccctattgacgggagttgcaccagtttcagaaatgcaaggatatgcccaagaagtccgggcttatacgcatggacaaggtcaattggaatgcatcattgatgggtatctgccttgtcacaatgcagaggagattatttcgagtctgaagtacaagccagtttcagatttggaaaatacgccggattctgttttctgtgctcatggagctggctacccagtcgcgtgggatgatgtgccagatatggcgcatgtggcgtatagatattaacagaaaatctacggtaacaaaaacggctacaatcatccgattgtggccgtttttgtggtattatttattcaatttcttcatcaactgtttcttgtgtagcttgtttcttatcagttgcggtttgcatgatccctagcactgcacgggcaattggaccgacaatgagaagctgaagtggtaaagcaacaattaggttaaatccccaagtgtgcaagtaagtcatcaaaagattaccgccaaaattgtgtgccataatcattccgaaaagtgacatacatgttaccattccgaggaccatcaatactgaaatggtaattccgatgagaaccacatttttcttcatataatcattaatgatatatttgaatgcaagtttcttggcaattgggccaaccactagcaagtctaaaataattgcggcaagtaagccacctggatattcagagatggtgtttaacataactcccttagtgaatccttgaactagtaaaacgttatagcaaaccatcacaaaaaccattaatccggccatgatggcagtgaaaacaacttcttcttttaaatttcttggcatcttattctccttcgtgtttttgagcaacattagttagtataccgggaaattaagaagcttcgtaagttacgtttgtataacgtttttgtaagggcttaataaaataatgtgaggattgatgataaatatgaaaattaggattattgggtcaggaaaaagtttggtcctagttgcaactcaagtcctctttttaatgcaacaatgatattcaggagtacaattaaatttagcaccactattttacataaaaggacttgagaatatgaaaattgaagaaggatatatgccatttcacggctataagacttattatcggattgttggagaaccaagtaaggataaggcaccgctattattaattcatggtggccctggttcatcacacaactattttgaattgttggatgattatgccaaaactggtcggcaacttatcatgtatgatcaagtgggctgtggaaaatcgtcacttcctgaagatgaaggcgtttatgtgaaggaaacgtgggcagaagaattggttgctttacgtaaatatctccacttagacgagattcacatgttgggccaatcatggggcggcatgctggaaatgtactatttaactagttacgaccaaaaaggaatcaaaagtgtcatgattgatggctcaccagcttcaatcaaattgtggactcaagaacaacaccgtttgatttcatacttaagttacgaagatcgtgcagccattgcggaagctgaaagaactggtgacttcagcggtcctaagtatttagctgccaacgatcgttacatggagcgctattgttgggatgatcctgatgaaaattcaccagaaccattgcgcagagctaccaacggaaaacgagctagtttgattgctgaagggcctaatgagtttacagaaaacggcacaatcagtgattacgatgtgacggatcaacttaaaaatattcacgtacctgttttagtgactaatggaacggacgatttatgtacgccattgatcgcaaaatctgtttatgatcatattcctggtgccaaatggcatttgtttgccaatagtcgccacttagcccttttggatcaacacgatgaatttattgatgtgctggaccattggttggcggagaacgattaaaattaaacagagaaatacactcggttctgttcaaaaaaaggatcgagttttatttttattatttataacatgtggggatgcgcaatactgtataattttagcaatgaactggaaaaattaacttataggagagtcagttaattgaaaatcaaaaaattaatttggagagtgaatcattaaatggcatcagtaaaaaaagtattaattgataagatggaacagttgttgcaatctgttggcggtaaaaatcgaagtggagaaaacttatttattacgcgtggggtagttcaaaacgatctgcgaccaaatgaaaaaggaacttatggattcatttcatttattcgcgctgatcagcagcctagtggcccatattcaggattatctattaaagtgaatcccgggaaataccattatcgcatttcactagatattggtaatgaagggtttggagatgattatcaactcgctgcgcttccaggaacccgtagaaaatatctagaattacaacacgatattttaacttatatcaagacaaaaaatgcagacataacgtgcttcagtgctttagatttcaccgatgacactaaaaaaagagaactagctaaactagaaactgaatatacagaagataacattgattctcatcctgttgatttatttgtggctttcgtcaaacgaccagaaattgaagaagcaggtatcgatgatgaagatactgatttttggaaagtatttaaagcggttattgcagtctatgctgaattgagacaatggcctaataaaaaagaaacagatagagcaatcgcatttaaacaagcgttaaaactaacaaaaatcgtgaataccactgatgagatgacgattgtaaaacatctcttaaacaaacgaaaatatgtggtggttcaaggcgctcctggcacaggaaaaacatatttaactggaaaaattagacaaaattataaagatcaaaacgtgttttttacgcaatttcatgctgaaacaacctattcagattttgttggtggataccagccaatcactgagcgggggaacctaacttatagttatcaagaaggtccacttgttcaagcaattagacaggcaaaagattctaaagatccagtactattaattattgatgaaatcaatcgagccaatttgagcaacgtattgggagaggcattctatttatttgaatctaacgcgggagaaaatcgagctgaagttaaattgggaaatccaatttcggcattacgactcactaaattaccgaaaaacatgcaagttgtagccacaatgaacacagcagatcggtcattagctgtaatcgattttgcgttacgtcgtcgatttgcctggtttacgatgcgtcccagagagctaaaaaatacggaactattatctggagaaaaatttcataaagctctatttaatcgactgcatagcatttttcaaatgtatgcaagtagtgacgaactcatgttagaacctggacaagcttattttgtgacagctaagatagatgctgagcaagcaatgaaagaaagattgaagtatgagttgctacctttgatccgtgaatatttagaaaatggcttgatgacatcggcatctgacgcatttaatcaattatttattgatgaaattgatcagacgttgtttgtttaatttgatgaggtgagtttatgggacaagataatcaaatcgctattattgagttacccactttcactaacaagatctaccatttaccaaagaaaatggttgctgaccatcgatatccaaatgaggcaaatgatgcttttattaagcttaatcgaaaagcattcgaatttttaaatattgaagcctattcgcaagaaggttcattgcacctgataagtcataattttgttggtacaatcccaatacgaatgcctggtggcgggagagggaaaccagttacagatttagttattaagccgagatatggagatcttcatgaacaggccgactggtttgaatggatgtctggtttagcggaattttctaaatttaaattagatccagaaagaaaacagcaactcaaactaactcgaacagcaggaacttcaactcctcgatacttattagccagggaacttattaattgttttttagtggtcgtccaaaagggccattggaatcaatttataaatcgaaaactattagtgggaaggccaattggaaatgttgattggaacgaatatgctaagcgtaatagtgatccacaccaagcattgatttttccaactcgaatcaatactatgactagtaatcatgttgattttcaaagagcaatgatattattcatggaagctaaatctgtcatagaagatcgcggcacacccaattctgtgagacaaagtgtgcacacgattttgcttcaactaactaagttactaccggcatcgacaaaatcatttgtttacaaaactgatctctttcaaacggccccacaggacgcacaagaagtacgacgcctaaaggaggcacttaacgcatttttactgaataaagaagaacagaagtacgcatggcgaatagacttttccaagttatttgaagaatatatacaacagctaatttcacacgttgtagctattagtgaaaacaataaacgcataccaagatcattgattccaggatatgggcatagagtttcgcgactcacaccacagtatttagagcccgacttagtggctaaatttgcgggagaaaagatgatactagattcaaaatataaatcgtatttttattctcgtaacaaggaaacagttcaagatcaacgacaacggactcggtcggatattcatcaaattattgcctatacaagtttggaaaattcaagaattgcaatcatattagcacctgttgaaggtactaaagtcagtgaagagttaatgtgttatggtgatatttttgtgggtatattaggcattcctttacaatataaaaatgcaaaactatatgttgaagtggtccgatcctatttcagaaaaatagtgagtcagttagagtaaggcaagattaacatgcttagtagggcgcattcctgatttctaaaaatcaattaaaaatgagtttatgctttctacttaagtttagccaatgctaaaatggaaggcataaatgggagtgattttttgatacttgaacgaaaaaactttatgaattttgataaactgaactcaaatttgaaacggacagttggggccccacagattaaagagatgcagaaattaacgcagctttatcagttaagtgaaggtggcgcgaatgaaattggcaccaaacttgagaatttggattctgagtttcaggtgaaccatgatcataatccgattcatcacatggaagaacgaatgaaagatatgcagagtctggcagaaaagttgcggcggaaaggctacgatctcacaattgaaaatgttcaaaaacacatttttgatgttgccggaattcgggttgttactaactacattgatgatgtttatttgattgaaaaactgcttgttaatcagtcggatgtgactttagttagacgcaaagattatataaaaaatccgaaacccagtggctatcgcagtttgcatgttgtcgtttctgtgcctgtttttcaagcggaaggcagtcaggatgtaaatgttgaaattcagatccgcacagtagggatggatatgtgggcgagtttggaacacaaattgcgctataaaactgacattgatgataaattggtcgcgcaatatggcgagcaactgcatgattatgcggatgaattagcgaacattgaagttaaaatgcaaggaatttacaagcatttgaatgactatgatagttagaaccttttgaatcaaaatttaaaacggagtattaagacggatgcagcctagattgaggtttcatccgtcttttttggtagttaaaaattacaaacacataaggtcacaatacggtatactttaggtatattagtctataaaacgttatcaaaaggaaaacagaaatgaaaaaacgcacaaaaatattattcgcaattataggagcgctaattgttttaatgatcggtggttggctgtatctacggtcacaaatttatcaaccaagccaatcggctactaaagttgcaaagcaagcaacaactacagaaccgcaattgtacttcaaaagtaaactcacaacgactccagaagttattttttatccaggggcattagtggaacctgctagttatagtatctgggcaaaacgagttgctgcggctggatttccagtttacattgtgcgtttcccaatggatcttgcggtgctggcgcctaataaggcgaaccaggtccaggataaaacaaaccgcggttatgttattggcggccattcattaggtggtgttatggctagtcgttatgcgaaaacgcatcagaagcacttaaagggtgccttctttttagcaagttacccggataaaaaaggtagtttaaaaaagactaattcatcagttctatcgatcactgccacgcgggatggggtcttgaatcagagtgcttatcaaaaggccaaacgctatttaccgaagcaaacggaatacgccagaattaaaggtggcaaccacgctggttttggcagttacgggacacaaaaaggagatcgtgacgctacaattagcgatcagagccaacaacggcaagtggcaaaacgattaattcagtggttgcacacactaaattaaatagttgggggagcttatatatggagaaattacagtttcaacttatcggtgatccagaagatttctttacgcttgttatgtcgagctgtcctagggctcagcggaaaaaaggtaggacgactggccagtgctggatgcggggagaattccccgctggaagcatgcttatttctttacgcttgttatgtcgagctgtcctaagaataagtgagttcttcaagtcggtaaaggggggcgtataagtgtgacggaggcaggatcgaaatcctgctgtgagtcatacttatacgcgcccctttgacttgaagaactgtcctgatgctcaacggaaaaaagcaagatgggctggtgacggaggcaggatcgaaatcctgctgtgagtcatccttatacgcgctcctttgatttctagtaattttcactatttgattcatctcaaatccccattgcgttaattttctaatagtcagataatggaaaacagaaactgagttttcagtgaatacgtgcgaatgcgggggagatatcatgagtaggtcaacacggggaattttatacgcgtcaattggggccatttgttggggaatttctggtcctattgcgcagctattatttaccaattacgatttaaaattgggatggttaatcggctcaaaaatgctcttcggtggcatcatgttgctggcttttggtctgacacagcccaaagaaaggccaaaattatttaccatttggcgtgataaaacagctattatacatttggtgatttttaccatttttgggatgaccgcgatgcaggcagtttattataaagccgttgcggttggtaacgctgcaacggccaccattctccaatttctatcacccgtgtttattgtgatttttacgattgtgcgctataaaaaagttcctcggcgcggtgatgtttgggctatcgttgctgctttagtagggacatttctattaattacaggaggaaacccgaccaaactcacaatctcaccggcagctttcttttggggtgtggtgactggtgtcgcagccgctgcatatgtgttgctcccagaaaagattcttgatcaatatggctcaatgacggtttctgcgtggtctatggtagtgggtggcatattgtttaatttcgttcaaccagtttggcgcgatgttcctaagtttgacgttgccggatgggcgggctatctatttattgtcgtctttggctcggtaattgcttatttcatttatttggccagtttggcgtatatttcagcaactgcaacgggactgctagacgcgttcgaacctttatcggcgacaattgtttcagtgatatttttaaacttaacatttggtatcatggaaacgatcggaacggtgctaattttaagtacagtgtttattttggcgctggctaaccgccattcatgaaaaacatgtagaactgttcatcttaatagggatgagcagtttttagattgtctagtttttagttgttttactggtgtgaagtgctaatatttagttaaatggaaccggtttacataatatgaggaagatgaggctgatgcaaaatcgttattttaaatttttaatgtatctgggcgtttggctcggactgaatattttgtggggattacgatcggcaattttgtattctggcgttagttttcctaccatgtttatggggatgatggccttgtcatttgcgccaattataggagttaccattttattgctgatgacgttgtttagaagtcgtaaattgaatcttgtcgctctaatttggatgattttggctagtgtaacgtcgatgccacctatttatctgctttcagttagtatgtttagtgttgtgtcagtacttgtttgtgatgcatacttggctgttattatttgtaatcgggatcgaccagttaaagcggttaatcaagttgctttagggcttatcgtgattttcgttctttgtttattgtcaccggaaataagtgctcgttttgccattaatggctattcagatccgaacaccgctatcaaaactgaagttcaattaacatcaaaaaataatgatgcattgcaaacgaatggtctaacgacggtgacaccacgacgacctaacgttgaaatttcgggggtcgggaatattaatattaagattcaacgtatcggcgttttttatttttcgactgttggtaactatagttatgattggtagaaaaatgagatcattattaatttaaaaaatttaatgcgaattgttacggttgagatattgaaaaaaaggaccagattttttaaaaattataatagcaatctaaatgtacaacaaaggctaaatattttggtgaaaatcaggccgaattttatgaaacaatcgcgtaattttgcatttgtcgcgtatggtttcttgatttataccaaattactttaaaagggagtgatcacgtgcacagcaaatatgataagtatatattagaaatttttgggattttggaatttgtaaccttcataataggatggcgcaaagtcagtggtatttgggattacttaacagcggatatccagcattcgtttaaaatgattccagaaatgtaccaactttcaaatccttttgattttagtgttagcattagcggacttcacacgagctacctatttgcgattggatattgtgccattcttattattcagtacgtggtgcttctttatataatgaatcagtttacgatgtgtttaaaagactactttcaccttcggaagacaacattggaaaaacattttcaaagaatgtcttttagtttttggctcttgtcgggtacagtgattggccttcaaattttgaattctgttttagcacagcatgttcggttatttaaaccagattttttaatagaagttatcgtggtttggttcttagcgattgcttttcattatgtggcaagtattatcgtgaatatcaacaaatttgtagacaactaaataggttaaacaaacaaatctccgttttagaaaggcgggtgagttttatgtttaaaaggggacaggttctaaaaatttggattatagaaatagcaatcttgagctttttcatgatttcaataccggtccatgctcaagttaatacgggcagttctgcaagcacaagttcgctaaaaaattcatcgagttccaatgcctcaagtatcgctaagcaatctagtggcgccactccaacgatggataaggcagtttcaaacgcaaaaattacggttaaatatgtgaatcaaaataataaagaaattgcgacccaaaaagttttgacaggtaaggttggcgccaagtataacgtcacaggtttacaaaaaacaattaagggctaccaactaaaaacgaaacggaatgtaacggggaaatacgctgctgaaaatgcgccagttgtttttaagtatcaaggtgtgaaaataagattatcaatccgtgatattgataacttgggtaacaaccttaatacggggaagaatcgtaatcggtcaattactggatattatggcaacatttataagattaagactttaaaatcaaacaaggaaacatttatcagtagttcatctgtactaactggtttgtatcctctgaaaaatcagacaattacattacgctacacgaaaacgatgaatgatattgtgattggttcagataaatcgatgaccgtttcggggattatattaggcaacttagccaacgtgattcaaacgtatccaaatggcgaaaaagttgctgtcattgtcggtaatgacggggtttatcgagtgggaaccaccaaaaacaaatatgtgatatctggtttcaaacagcttaaaacggttaaacgggggcgaactgtcgaaactatttctgccaaaaggacacgtacgaaaatcacaattttgccgtcaggttatgtgcttattcaaagaataggaaacggtaaaaattatcaaacggatgggtcaatgaccagtccgagtggtcacgtgactagtattatgacgactgttaaaaatggtatgaaatctgaagtttcagaagaatctggcacatcacctactcaagttgttcagacgtggccgaatggcgatattttaacaaccttgatggtcaacaagcataagctacagctgacgcttcaaaataaggcaaagaaagttctgagcacaaaggtcatcacaaaaagtttcggtcatggtcaaatttttaagttaggtcaaagccagtaccttgtttatcgagttggcgctcaaaagacaatcaccaccactttaattagcggtaatcagtacaaaaggcagtcatttacaacgcatggtgtggcaaaggtgacgcaaggcaaaattgctttgaattcaaccgctaaacaggccttaaagaaggaaaatttacaggcttttgttaaagctatttctagttcgaaaagtaattcggttcaaactaaaaagctggctgataaaccaaaacgaggtacaaaaagtagtaaaggagtattaccagcgacaggtgaatcaagactatcggctgtcttcgaaattggattattgtcaattatgtggatgatttgtttggaaattaaatttttatcataaaataaaagcgtgtcaaaccgcagttacctgttgttgacacgctttttattggggaaatgagtatttaattcaatagaagagcagttgattgataaggtttaagctcaattttgggtccaaccgttgtctgctctgggtagtttgaaattaatattttaccactccgattagctaatgaatctggtaattgaacagtggttgatttgccataaaaattattcaaaactactagtgtttgacctttataatctcttaagtacgcaaaaacctgcggatcattttctaacagaggcttaaaatcaccaagtgagataatgggttgtgttttgcgtaatttgattaatttttgatagtaagcaaagatttcgccagttactaattcgtcttttacattcacttctgcctggttagtgggcatcaaccaaggtttgtgagttgaaaaaccggcatattctgaattgtcccattgcatgggtgttcgactgttatcgcgagacttagtttttacaatttcaaaggcttctgtggcggattttcctgctgccaagagttctttgtaggcattcttacattcaatatcaacgtaatctgccattgaggtatagtctggatcgctcatcccaatttcttcacccatataaatataaggagttcctcgcaacaaatgcatggtggtcgctaacatttcggcggattttgctcgataatggaccggatcgccaaatcgattaagcgcacgtggctggtcatgattattccaaaaaagcgcgttccagccgccaccctttgccatgccaatttgccagtcgttcaaaatctgcttgagtttcataaaatcaaatggtgcctttgtccatttttcgccattggcataatcgacttttagatgatggaaagtaaaaaccatcgttaattcatggttggctggtaaggtgtattgcacactgttggcaatggacgttgaagacatttcgccgaccgtgatggcatcggggtcttgtccaaaactagctgtattcatttctttaagatagtcttgaacaacaggcgtatcagtgtaaagcgtcttgctggcaacgtcagtaggggcgtcaactaatttagtttctttaccagtgacattgatgacatcaaaacgaaaaccatgaacgccctttgctcgccaaaaattgattactttataaagctcttgtcgaacttcaggattatgccaatcgagatctgcttgcgtaggatcgtagaggtgtaaatagtattttcccgtgttgccaaattttccccaggcggggccgccaaatttagattcccagttggttggtaaatcgccatttggttttggatcgcgaagataataaaaagcctgatactttttatcgccggccaaagctttttggaaccactcatgatcggtggaagtgtgatttaaaaccatatctagcatgatgccgatgtgggcttccttcaatttggccgctaactcttcaaagtccgccatggtgccaaaagtagggtcgactttataataatcggcaatatcataaccattatcgttttgtggtgaaacaaaaaaaggattgaaccagatcatatcaatgttcaattttttaaggtaactaattttggcaataataccacgtaaatcaccgataccatcgccatcactatcataaaaagattttggataaatttgatagattactttatcttgaaaagtcattttcagtacactcccttaattaattttttgacgacgagcaaaatcaacaaaattaaacttgtcgggtcgatgaattgattcggtaaattcaaacagcgtggtgtcttccaaataggtctgactgcgaacgaccactacgtcttgatggtcgcctaatgccagcaaacgtgcgacctcctttgaaggatgttccacagtaatcgttttggtggcgtaactaatgatcaaccctagtttattttcaaaataattatacaaagaatctgctgcaacagcgtgtgagatattgggaaccacagactttaaaacgtagtcgcggtcgagaacgattggattatcatcaattgtccgcaaacgctcgacgaatgtggcgggtaagttttgatcagattgataatcgaaattttcaaggggcacatgctgatcttcaatgcacagcacttcagtttttgaatgcatgtgtaatgaattatttaattccttataagatgtaattccggatactggaaagttgaaacgctgtaggtttaaaacaaccgaacctttgccacggattttttgaatgaaaccgtttgtcagcagttcagccaaagcttttcgaatcgtttctcgagatgttccatataattcggctaattgagtttcactaggcaggtatgttcccacaggatagatgtgatgaataattttgttagctaaatcgtgatagatggcaccaaatttgtttcgcataactgctcgcctcctaaaacgcttccattctaccacatttaaactagtatagacaagttgtaaaggaaaattttctactatcaatgtgtgaacatacactaatagtggagttaaataaaaataaagcaagatagttgacatcctgtatatacaagttgtatgatgactctgttgttaagaaaacgctttataaaactaaaaagtaattatccagatgggagggatacaaatgtttggatttggaaaaaagaagaaggtcgctgaggataacaccatctatgctccggttacaggaaaggtaattgaccttagtgaagtcagtgatccggtgtttgcacaaaaagcaatgggcgaagggctaggagtgaagcctagtgatgaccgcattgtgagcccagttgcaggtactgtcacgatggttgccagtacaaagcatgctctaggaatcaaaatggccaatggacttgaggttttggttcatatgggtgtcgatactgttgatttaaaaggcgcaccatttaccatcagcgtcaaagttggggatattgtcaacggtggtgatgcaattgccaccatggatttggatcaggttagggatgccggacttgatgatgtgatcattgttgtcatcacaaattcggctgataagttagatcatttagatctaacagctggtgatacaacagcaaaatcacaagttggttcagtaactgttaaaaattaggggaggtttttaaaatggcaaaggactacacaaaacttgcttccgacattattgaaaatgttggtggcaagagtaacgtcaaaagtttgattcattgtattacacgtcttcggttttatttaaaagatgaaagtcttgctaaagatgatgtcattcaaaatttggatggggttatttcggttcggcatgcacaaggccaatatcaggtagtaattggcgcagctgtgagcgatgtttatgacgcagttattgcacagttaggtcaagaattcgcggatcctgatgctactgcagcagctgttgcagagacagaagctgctgcgaaggaaccagataatcggagctttacacaaaaagttaaggatgggtttgattcgttaattggtgttattaccggttccatgatgccggttattgggttgttggctgctagtggtatcttaaaaggactactacagatggcagtttactttaactggacaaccgtgacttcacaaacttatgtgattatttctgccatgggtgattcggccttttacttcttaccggtcattgttgggtttacggccgctcaacggttgaaagctaatcctgtgattatggctattattggtggcgtattaatttatccttcattattctcaattgccactggcacaaaagtaacaggacatttgttaggaatggctttgaacacaaatttgtttggcttaccaatccatttggtaaattatacctataccatttttcccatcattgcgggagcatggatggcacattatattgaaatttggttgaagaaatggattccacaaattctccaaatgatcttcgtaccattatttgaagtcatgattgtgtctgctttgatcatgattgtcgtgggcccgattatcactttaatcagtactggaatttccgtagttttagatgctgtattgaagttcaattacccaattgccgggttgttaatcggtggtttctatcagattttggttattttcggattgcattgggcgattgtaccgctaattgctaacgatatcgcttctaaagggtacagttatttaaatgcaattgtgtcaatgaccatggtggctcaaggtgctgctgtattagcaattatgatcaaatcaaagattgcttcagttaaagagctttctggtgctgcagcgatttcagccttcgtcggaattactgaaccttctatttatggtattaacttgaaatatggccgagcgttcttgacggctaacattggggctgctgccggtggtttggtaactggattactaaacgttaatatgtatgggttcacgggttcaattattgggttcccatcattctttacacctgctaaatttggtggtggaattagtaaccagattaatttctggatcgcaacgattgtgactttagttgtcgcttttgcctgcacatgggcatttggtttcaaagactcagatgttgaagctgcaaagaaagttacgcgtcgtaagacaattggtaaaaatgcttaattaaaatatattttatgaaataacgaatgattgatgcgaacccccagtattggaccaaaatccaatactgggggttcactttacaaaaaggtcgtctctggactcccaatttgctatttttttaagtcaaaacacaagatcaaaagtgcatatcttagtcaacttcacagaataattgttcttatgttattaagaaatgtgttatcttcatagtggaggggtgtatatgaagaagaaaagatggttgtcaatatttggagtgttagttcttatcatatgtggcgtggttgcatacatatatttaaattctgatatgtataccgttaatcaagtgaattctaagatgaatagtatgattaggggaaaaaattacaaacaaatgaaagctgttgctaataatcaggatacatatatctttttaagaagtctgtctagcaaagatagagttaatgatacctcggattttcaagggggctctgacgagaatgcatattacgttacagtagtaaaaaatcaagatttaaatgtttatatgcgtaaaacggggatagctagttgggagattcgtcgtgttgaaaaacaataaaaaagctgttcagtgagcttgaattatgcgttcttttgattaagcatatttaaaggttctgggtcactgtacaatttggagtgttgtgtaacataaaaatttaatccgtatttttatagaagggtcttgccataaagttcgttttggagtattatcaaagctattcagaatattaaaaaatgctgtgaacagataagtaggaacaaagcggattttaaagagagctaggatagtgaaaactagtaatgaagctgtgccgaaaatggtctgggagcattgcagtgaaattaaactttaagctgcgggtgtaaaaatccttatgaatcgagatgaacgtttttgcgttcaaataaaggtggcaccgcggtcaagcgtcctttacttcaaattgaagtaaaggcgtttttttatacttaggaaacaaaatttaaaaactattttgggtataagggagagagacttatgaacaaaaaacaaggtatttcagttagaacggttgtggcaatcggaatcggaacggcaattttcttcgttttaatgcgttatattccaattccaactggtgttccagacacgaatgttaatttggcttacggatttttagctttaatgggtgcaatttttggtcccgttgcgggtggactgattgcctttttagggcatatgtttaatgacttaacttggggcgaaccatggtggacttggatcgtggccgatggcatctatggtattttatttggtttaactaaaaaatatttaaacattgaaaacggtgatttaacggcgcgtaaattagtgcttttcaacgtttaccaaatcgtcattagcatcttggtctggggtataattgcaccaactggtgatgtgctcgtttattctgaaccagcttccaaagtttatttacaaggaattacgtcaatcatttgcaatgcgctttcagttggaattttaggaaccattttgttggttgcttacgcacggacccgttccaagaaaggcagtttaaagaaagagtcttaattttatgaagaaaccaattattagctttcaggatgtgagctttcagtatcaaagtcagtcggaaccgacgctccatcatctgagttttgatatttatcctggtgaaaaggtgttgattgccggggcgtcgggttcaggaaaaaccacgattagtcggctgatgaacggtttgattccgtcagcttatcccggagaactaagcggtaaaattttcataaacggagaatcggtcacggatcaaacgatctttgacctttctttgcgtgtcgggacagttttgcaggatccagatacccaatttgtgggattgacggtggctgaagatattgcgtttgcattggaaaatgatgccgaggatcagtcggttttaaaacaaaaagcgaaggattgggcgaaacagctgaaaatccccgcaattttgaataatcatcctcaagaaatctccggtggccaaaaacaacgggtttcaatggctggtgttttagtggatgaaggtaaaatccttttatttgacgagccactggccagtttagatccgattgcgggacgggaatcgattgagttaattgatgatatgcaaaaaaatggagcaacaaccacggttattattgagcaccggattgaagatgttttatatcggccggttgattggattatcttaattgatcagggaaaactggtcgccaatgacacgccaaatacaattttgaaaagtgatattttagctaaactgggattacgtgaacccttgtatttgtctgcgttaaaatacgcgggaatcgatctaactcaggtggctgatgtggatagtgtgggtaaagtagcattgtcggcaagtacgatcagtgcattacaggcctgggttaaaccacaacaggctcgagtccaaacaatggatgttaaaccgatgctacaagctaataatatttcatttagttatgattcgaaacaggttttaaataaattaaacttaaacattaatgcgggtgaaatggtgagcctagtaggtcgcaatggcgttggtaaaacgacattaagtaacattattactggctttcttcaccaaagctcgggtgatttggttttgaatggtcattcgattaatgaggcgtcgattaaagaacgtgccgatcatattgggtatgtcttgcaggatcctaacatgatgatttcaaagaatactgtttctgaggaagtggcgctaggcctgactttgcgggcagttgctccagatgaaattgaaaggcgcgttgctgaaacgttcaaggtttgcggcttgtttgagtttcgtcattggccaatctcggcgttgagttttggtcagaaaaagcgggtcacgattgccgcaattttggttttgaatccggagctactgattttagatgaaccaaccgcgggtcaagattggcaacattatacagagatgatgacatttattcgtgacttaaatcgtaaaattggtatttcggtgatttttattacccatgatatgcatttaatgatggaatatacagatcgcgttgtggtgctaaataacggtgtgattgcttatgatgatcagccgatgaaactcttcgcaaatttggatctcttgaaacaggcgtcattagtggaaacgagtttgtttacattggcgcaacggatcaaagttgatccagaagctttgattgcgagctttatcaatcaagaaaaggtggttcagacgaatgaataacaatgttttgattggttataaacaacgtgataactttgtggatcatttgactggaacaaccaaattaattggtttgattgcgttatccgtgattggaatggtgagctttgacactcgttttttactggtgttgacgattggttcattggcgttatttcggctgtctgggattaaatttcatgaagtttcttttatattgagctttattacggcgttttcagtgttgaatctaattgcagtgtatatatttggaccgcagtatggtgtgcatttgtatgggtcggagcatgtgatttggcagggagtgggcccgtacaatttgacgtgggagcagctgttttacgagtttaatttgtttttgaagtatatttttacggtgccgttggcgttggtgtttttgatgacgacgaatccgagtgaattttcatcgagtttgaatagaattggggtttcgtatcggattagttatgcggtgtcattggcattgaggtatattccggatgtgcagaatgattatcgtcagattagtaaggcccagcaggcgcgtggaaatgagatttctaaaaagggaaagttgacgcatagggtgaaggcggcggcacagatattgttgccgttgatatttacgagtttggatcggattgagacgataagtcaggcgatggaattgcgtcgatttggaaagttgaagaagcgcagttggtatgcggaaaagccgatgaagagaagtgactttgcggcgttgatggtgattgcgttggtggttgtgattgggatttgtttgtttaagctgaatgcgggaagattttatgacccgtttagataaaagtgagcgaggcaaaacgataaaagggagaatataagcgtgccgtaagcgggggactccccgcagtaggcaggcttatattttcccttttgttttgccgagctgtcctaaggctcggcggaaaaagccaggcgaagaaccggatgcgggatcgcaatcccgcgggaggttttcttatgggtccttttttgctttctcgagctgtcctaaggctcagcggaaagcagcaggcgaagaccgtaagggggggaaccccacgcagtacgctatgttcagaatcaaaacaggtaatttttcactttttttaatttttttgtttacatttggcatcctgaaacgttattagtatatgtaagccgtcgcgacacttactaaaatgaaaagaaaacttggagggtatcaaaatggaaaagaattggttaaagactgctattgcagtaacaatgtcaggtgaaggtcatgaagaaggtctcaaacgaagtttcgctaatatgccagaaactgtcactgacgatcagatcaaaggcttaggcagcgttcttgaagcagtttcaaacgataaatttgattttgcaactgtcacaactacagaaaaaattgtaaacaactaaaaataaaaaaatcccgctcaaaaactactatgtacatcaaaaatcaaggaggatccaaatatgaaacaattagatatggaattcgtaagcagtctcggcaaggtacgtcacattaagttgaagtatgtgaatgaagggttagaggcccccgcagtaaaaactgcaatgacacaattagcaggtttgaaattattcgtgaaagatgacgaagaattatatgccaaaccacaagctgctaagtatatcgaaacaattgatacaccattgtttgatgatgatgcgatcaaagcgtaattaaatgaaaaggggtaaacgcattccgggaacggagcggttaccccttttttgagagagttgaaaataaaaagtgcttttttacgccagttttcaaaattagtgttataacaagggtgttggggtattctaaactaagacagactacacagcaagccggaagtggtacttggtggctactgaaagattactgtgcttcacccaaaaatataattggaggtttttgatatggcagcaacagcttatgtagaaaaaaccgcgcttttagacacggcaaccaaagatatttttgactggagtgacgatgcaactccattgcgtgatgcaatgtgggacaaagtcatggatagcaacaatcataataccgatgcaacatctgagcaggccgcaaagtgggaagacatgaatgattccgacttaaaggctgcagctgagaagttattgaagtaaaaattgaatattgaacggcttgtaaagttgctcaaattaaataaaagaattaacgaaaatgtgttattttcgctaattcttttttctatactttcataaaatggtcagcatatataattaatccaataaacaaaagacaaataccgatgatgaaaaatgttgtcccaaactgcagccaagtgattaaggcacccacaactggaaacagtgcaatcataactaggctaaacatcatgctcataacgctgagtaaggtggcacgtgcgtttgatggaatttgttgttgtaaaaaatcattgaaaattggttctaccactgcggttaccaagccaattaggacaaaacagccggttaaaataaggatgtgttgaaaaatactgagtaagaggccgacaatcattaaacagaccagaccaacaatgagccggcgtttcgaccagtgattttccagtgtcggtgcacttttggcacccaaaatgttaaagcaggcggcaatcacaatgatcatactaatttgccatcccgaaaaatggtagtgggtcatgagggtttgaaaataaaaaaagtaggtagtgccaattgcctcatagcaggccagaaacagcattaaaccagtagtgacgggatgactagtcataaactgccagctagttttcaggattgtggcaaagcttgtcggtgagtcggtttcgctagttgttgaagaatgaggttcttgcattcgcaaaattgcaataatggccaaaagagacgtaaaaatataaatgacgtaggttagttcgaaatgccaatgcacaaagaatccggcgacaatcagtcccaacatgtcagccagttcataaatggcgttgagattggctgtgattttgagatagtgtttctctaaatggtcggtcttgagagtctcaaaaacgagggcttcgttggtgccagagttcaaattataagaaaatgcttgaatgataaacgctagcgcaaaccaccaaaagccggctcccgataaaaagagaaatccagataggattgccatgatccgacccataattaaaactgttttgtaggaaaagcgatcggccaacgtcccagatggtacctcaaataaaagactggcaacgtgaaagatgctttcaaggagaccgacttgaattaagctcatgccatgttgggtcaaataaatgacccagaggctggtaatgctaaaaaatgcccaaaaactataatgatagttggcgtggatggtgcgtttaactgataaatgatttgaaaatttagtttccatgatgtcactcctataagtgtgtagcgaccatcaaaaaaggcgagtcgaaagtacgatccgccttaaagaaattcaattgtggctcataattaagcacgcatttgaacggtcgcatagttagattgagggttaaaaatggacagactggtcccgttagccttcaaaatgtacgattccgcacaaacgatccccaaaaaatcgaggtagtcagcaagatgattagatgttgaaatgactgacataaacgtgctcctttccgtgtaaatgataataaaagtgtagcatattcatttttttcgtacaaggtggttttggtgattgttaaaatttttgaatttagtgtatattttgaactgaacctaaatggaggacaaaacgacttgaaagacaaatatgaagtttatcgatatactggaatcccagtggttaaaaatcgttctggtaactatgagtttaaaacagacgagtccggtcaggtaaaacctcatgattggcgaacaggcaaacatactaaaggcaagtttaagcgaaatggacaagtatttttaacagaaaataatttgtttgtgaccgtaatcgaagttgaaaaaatgccatttaatcgccgccatactgtgacgccattgcaacgattcacttcggaatttattaatgaacaacttttaaaaacaggcagaaaagctgtgaggaatcttcaaaatgattaaatggtcagataaaaaaattaaagagtttcgagtcaccttactaaattggtatgatgccaattgccgtgaccttccctggcgtcaagatcatgaaccttatcacatttgggtttcagaaatcatgctccaacaaacacaggtagctacggtaattccgtattatcaacgttttatgaagcagtttccaacgattgaagcgctggcgcaagcgcccgaagatcaattactgaaagcatgggaaggcctgggctactattcccgggtgcgcaatatgcagcgagccgctcaacaactattggcagattatgacggtcagtggccgcaaactaaagccgaattacaggaactcgttgggattggaccatacacggcgggtgccattgcgagtattgcgtttaatcaaccggaacccgcagtggacggcaatgcgtttcgggtattttctcaacttttagaaattgaagcagacattacgaaaccgcaaacgcgtggtatatttgaggatgcaattcgccacattatacctgctgatcggccaggtgattttaatcaggctattatggatttgggcgcgagctttatgacagccaagaatccagataatgtccattcaccagttcgagaatttaatcaggcgtacatagatgggcgtgtggctgaatttccagtccgttcgaaacgcttgaaaccagttgataaacactactttgcgttagttttgcaaacccctaaaggttacctttttcagcaacgtgccagcaatgaactactagccaagttgtggctatttccgctgatagatacagatcagttaaaagtggagaatcctgatttgactgatgacatggttatcgaagccgctgaaaataaatttctggctggcactgaaattaaggctgaccttcaattcgtggatgcaccgattgtaaatcacacgtttacacatcaaaagtggcacgtcacattagtaagtgctgaacttcagaatcaaccagacttgagtcattttgctggtcaggtggtccctgtcgagaaactggcgacgatggcatggccgacactgcaaaagaaactgtggacagcctatgaaaaacggcaaattaagttattttaaacaagagggatataagcgtgaaaactttaattattgtggctcatccaaaattgattgagtctggaactcaaaaattcctaaaaactagtctcactaaaatggaagatgtgacgtggcatgtattggacgtgacccaacctcattttgatgtggctgctgaacaggctttgctacaaaaacatgatcggattatttttcaatttccattgtattggtatagcgcaccggctgttttaaaacagtgggaagatgaggtgctaacccgtaattttgtttacggaactcaacgtgcactagctaaaaaagaactgggcattgtcgtttctactggtgattctcagcgtggttttgtagctggtggggaggaacaattcaccttgtcggaatttctacgttcttaccaagcattggcaaataaagctggtatgacttatttacctccgttttcaatctttcagtttgcttatttaactgagacggcgaaacaacggttggtcattgattatcaacaatatattaccaatgctgaatttcaaaattttcatggacgtgagttatggtttgaagatcaactcaaacaaaaactagcagattcacctaattcgcaaaaattaacacagattttgacggccattcaggataatcgggaagatttggaagaattgggttggacactttcaatgatcaaagatgacgaggatgagtaaattggataccaatgaatgggtagaagcacaattaaaagagttatcgaaaatgagtaaacagtatgaggatcgggccttttatctagccttacttgatttagttgaagagcagcaaaaacgtttaattcaaagtcagggtgaggttgatggtcgaacttggaatccaagcaaatggtagtttatcgaaaaaaatttaaattatagcttgattaaaagaattaaaatggtatgataaaaacacatcttcaattcaagggagttttaattatgaaaattaaaccacaaactcaattgaatagcagtcgttattacttttggtttttccatgtgtgatttgtgggagccaaaagcgttttagagtgaactaaaaccggccgcacagatcacgtaaatgactgtgcgggggtataaaagtgttactgaacccttttcagtcattaatcgtgactgggaagggtttttatattttatgaggaggaagagacatgagtaaattgattggtcacatgaaaaaagagttagcagagttaaagccttcagatattttggcgtttaatcaggaaattgcggagattcccgatattgtcaaactgacgttaggggaacctgattttaatacgccggagcacgttaaagctgctgcaattcgaagtattgaaaataatgaaagccactatactaattcgcgggggacgttaggattgcgtaaagcagctgccaactttttgaaacaaaagtatgcattggattacaaaccagagtcgcaaatcctagtcacaacgggtgccaccgaagccatttattcgtcgttaactgcaattttgaatgcgggcgatacggtaattgtgccaacgccaattttcccattgtatattccgattacgatgttaaatggtgccaagccaatcttcgtggatacctccgataatggatttattctttcaccagagaagttggctgccgcgattgaagcaaataaggatacggtaaaggccgttgtccttaactttcctaataatccaaccggcgtaacctatcaacgtgaggatctcgaaaaaatcgcggccgttattgctaaatacgatatttttgtcattagtgacgaaatatatagtgagctaacttatgaaggaacccacgtttcaatggggaccattttgccagaacaaacccttgttttaaacggcgtttccaagtcacacgcgatgaccggttggcgaattggattgttgtgtggaccagcggatgtgattactcaaatcggcaaagtgcatcaatttgcgattacttcggcaaccacaaacgcccaagctgcggctcaagaagcgtttgaaaacgggatggatgatgggcagaaaatgcgcgccgtttatcaaacccggcgtgatttattattagaaggtctgactaaagccgggttcacctgtgcgagtcctaacggggcattctacctatttgccaaaattccagcaactttgaatcaagatagttggaagttctgttacgatttggctaaaaaagcaaaagtggctgtgattccgggagcttcgtttggtcctggtggtgaaggctacgtccgaattagctatgcagctagcacggaagatttaaaaaaggcaattagtcgtattcaagactatgcagcaaaacaggcgttatcaactgtcaactaacacataatacgatgagtggtcgatatggatcagattaaaaccaagaaaattagtaaagaagttgtgatgaataccttaaacggattatcaattggaattattgtggcgttagtcccaagcgtgttattgaatcaattgttaactgccctattaccagtatttccagcgggcagtagtattatgatgatgacgaatgccgcgatgtattgttaccagcagtgagtgcagtgtgcgtggggatgctggctaaattttcaccgattcaaaccacttcaattgccttagccgcggtgatgggagctggcaattttaaagtcggtaccaacggatttttagtgagcggtacaggagatgtgatcaatattgcgatcaccattatgattggttacgtgctgattttgttattaggcaaacggctaaaagcttacacgattttattaattccaactttagtgctggtgattgccggcggaattgggattttaacgttgggtcccgttagtgggattacaaaacttctcggtattggaattatgcaattaaccagtttacagccattactgatgggtgttttattaggaattgtttttgcacttttaattatttcaccaatttcatcggtcggtattgctgcagctatcagtattcatggcgtggcagctggttcagcaaacttagggattgttgcagcgggatttgccttggcaatctatgggtggaaagtaaactcagtagggacttccttggcccacttcttgggatcaccaaagatgcaaatggcaaacattatgtcacgcccaaaattaattgtgccaattatgattaacgctggaattttgggtggcctcggggctgtcttgaatattcaaggaactgcaatgagtgctggctttggtttctccggattaatcggacctgttgccgcacttaacgggatggaacaagttacagctggctcgataattttggtaaccattatgtttcttgtgttaccaattggattaggattggtcagcaattacctgtttgcaacgaaactccattactacgaaaacagtgattttgagttgaattacgcttaaaaaaattttgaagttcagattgagtagcctctataaacgaaaaaaacggtgttcaaattcttatctagagatttgagcaccgctttttattaatcaatggccaacagttatttgtaactaaagctattggcttatattgaatgtataaattcacattcgttaaacgttcgttggattatcaacaagacattcgtagataaaagaaacagcatcgttagaattttgagttgtgttcatatatctcgtctccttatttgaataattaaaacagtatgataaccattgacatacattctaatcactttataattaatgccaacacattttataaagaaggaaattataatggctagttatattataaatgataagaattttgattgttatgaggttattcatggagaattttttgactgtatgaacgaggtcttatcaaatgcctaaaaaaatatgtgatgtctatgacccgttattacctacattactaatatcaattcacaagatatatgtcaagcaaattttaagcggcaaaaaagtcattgaatatagaaaagagttttttaatgatccgtttcaagcctttgtttacactactggaaaaaatggtggtattgaaatgtttatcaaatgcgatgccccaattatagataatgcacataagttagctacgatcggggaaacgattcaacacgataattacggtgatatatttgattacttcaaagaaaaaaatacaggatatattattccgattattgaagtttaccagtttaaaaaggtagaccttcaatatttacgtacagaattaccgagttttgttgttccacaaaaatacttatttttagatcggcaggataaacaaaatctacttaacttattattgcaacaggtatgttcgaacaaattaataaataactgggatttttattttaaacaagcaaaaaaatgtattgactcaatcaatgataattaggcaaaacacatctgtaaaagtagctgaagcagtgattaagaaacaactggaatttgctcttaatttttctactataagatctgggaaagcttatctgacaaatttttctaagcataaattagtgtctggtttcattgaaggctttgaaggacttgaaatggtatatggaatgtataacactatttatcgaaaaacaagcaattaaataaacgattttcaaaaagataggtgactaaaatgattaaagactttgtttctaagaaaccagcactatttatatttaatatattattaagtgttgtaagtatgggaagctctgcaattggtagtgtaatttttgcgtattcttttaatgcgcttaatcaaagaaatttggccaaatttgttcaaatgaattttttgttttttgcattttcaatattatcagatgttacaacctatcttttctgtgtctattcaaaaaaaatgattcaaaactataaccatgatttacggtatcactatatccaaagtttgataaaaaaaactaatttttctgaaatagatgtcaataagcatattaatgcactgaccaatgatttattattactatctgaaaaatatttgtggggatttttaaagatggttaacgcagtttttaaaattggcttttctatttttgctttatttacatttcattggtctttagtgttagcttctatgttttttgcagcattaatgttgactgctccagaattctttaataaacgcttaactaaagttacggaagacatttcattatctaatcaaaagttgatatcaactttgaatgattggcttggcggattgtatgatttgagctggagtcaggttacaaataagttatggtcaataataagccctaaagctacagaattagaggatagctatattgaagaggcaaaaataaatagttttgttggtgagtggagtaatattatttcaaatatttctactgtttctttaactattttagcgagtattctttattttaatggattagttcccttcggaattgtagtaaatattgggagttttatattttcaatatttactggacttgtcacaatcagtaataatattgcaacacatatatctgggaaaccaattagtaaaaaatatcaagagatactatatacggttgataatagaagaatagaaaaaaacatattattaccaaatatgtcagtaaaactttgtgcaaataacttaagttaccgctacaaagataaaataattaaataccctgattttaatatcaagcaaggtgataaggttgcattagttggtcctagtggagttggaaaaaccactttaattaatattctatcaggtgaactttcagattacagtggagagttcacgttaaatggtcaagaaattaaagatattagtttgaattcgttacatcacttgatagggattgtgccacagcatagtcacttgtttaggactacaattgctgaaaatgttttgttatttgacgaaacgttggaagataagttgcctgatgctttgaatgaagtgaacttatctgctgtcgtaggtaatttacagcatggtatagatactgtagtgggtcccaatgatgaaaaattatccggtggcgaattgcaaagaatttcattggctcgtgcattaattcgtaacaaagaatttttgattatagatgaaggaacttctgctttggatgaaagcaatgctagagacattgtgagacggttgctgaataaaaagagtattactttgttaatgatcacacataccagtgatcggaagttattgagtgagtttgatcaaattattcaattgagctaaaaacagataatatcgatgtgggtgtaagttccagctataaagttaaaataaaattaaaaaatatgttgacttctcattttatctcgctataataagtttattaaatcaaagggagatgaagtcacatgcaatgtacacataaattagttaacttgatcaatttagtcattattagcttaattattaaagtgcacggtgctgtgactttaaccttttagctaataactttttagtgaaccaaaaagaggataaaaaagttacccatcgtgctttcgaaggaaagatgcggtgggtatttttttatcctcttttaatttgctttaggcatttcaaaatacttttggctctttgtcaaatggtgttgaaggatagtttctatcctttggagatctcctcgccgcaacttcgcctgcggggtggctaacttgttcttgcaatttccgatcagtaccaaatttatctaaatcaataataattatttcgttgatttaataatcattcattagtttattagccaattttgaattgtttcttattcttctcggcaaactccttgaatgaagttaatttaatatcgtaactttttaatagatcaatattaacattatatccaactgtattattccactcatcaccacggacactataaatatgcataccctctgctaatgcctcatcaggactaagcgtgacaactttaagcgttttaccagttaccgctgaaatagttgcagcaatttcgctataggacagtgattctgccgctaattcaatactttgatgattaaacattttcggatcagcaaaggccgcaactacaaacttcgcaacatccgtcatcgcaatatgatcgatacgcgtatctgctaacactgctgttctaatctctccctgcttaaatcgcggatacatggactcaactttctcagtgaagttttccatcatcgcggccggcttcaagatcgtccattctgcaaaaccagcggaacgaactgcttcttcaatatcccatttatcggtccagtacttttcgaaccaatatccggtcccccattttggaaattctttgtatcgactggtggcagcaacagaagtgtgaacaaattgttcgacgctatttttcactgcgctatgaatcaacgccagagactgcttacgctcgcgatcatttctcaccgtatccacaccagaaatcggtacagaaaatacggcgtcaacatcctgcatcgcattgtctagggaaacaggatcatcgaagtcgccaataacgacttttgcaccctttttaatcagctcttgcgcttgcgctttcgctttgttccggactagaatacgcaccttgaatccttgttttaaagcctcatcggccaccgcgccaccttggattcctgtggctccggtaactaaaaataacttttgactattctcattcattgtattaacttcttcctaatctgttttgaaaatctcatgaccgttttgtagaaacactattcaagtttgacaatgtcagtgtttaagttatactactagcaagagttgacactgtcaatgttattaggaaaagttagacattagggaggttttgtcagtgtatcaaggaaaaaatccagcagctttaaattcacaacaaatgttattagattcactaacggctttattaaaagagaaaaactttaaggatatctccattagtgaactttgcaatcactccggtatctcacggcaaacgttttattcgcttttcggcaacaaacaaaatatcttactctatcagttagagcacgcgccgtatgtaaagcagcctgaagatgatgacacatcagatatgacattagaagaaatcagcgatcggtttagtaaatttgtagtatctaattacgcgcaactgcaaatgatcatggataacgacttgaatgacttactaaataaactaatttctcaagccatgtctgcatgccaacaaagttttatcaatctggttaatgacgagaaaaactatgctgtctcgtttatggcggcaggtatatgtagtttgactcaaaagtatatagaggaacatgacctccctaaccaggaagaactcactcggatttcttacaagatgatgtcgggtagcatctataggtactgatctagaaaaaaatcgtaacatcaaaaaaagccctgcaaccgcagagcttttagtattattttatgcaaataaattttgcctggaaaccatattaatttatatgattttaaactactgttttaagttaggaagtctaaatatcggcgtccaccaccaagttaacttggtgacttatccccactcgactgttgctgatggcttgctcgtgatatcgtaaacaatgtgatcttcacctttgtcacagataatttcaattacatcatattttaaaaattttgtcagcaaccacaaatcgtgtttactatccaattccagattttttcgtaagatcaattgccgcatcacaagtatccacaaataagattccttttgcataattattccgttcctgataggcttgccacaattgacttaaatttgaatcgagcttgagagtatttatagttttaacatagtcaccaattttagcacttgttccgcgattttctgaagttgcataaatggcttttctaagtaaatcaaaatcaatgaacttaacgctttgccgatcaaataaatacaaatcataatagtccttcaaccgtgtattgaaaaacgcacgattaacgattgtttcaagtttttctgcaacaatcgtttctaggttataagccataacttgaattgttctgtcttcgagtaacagcttatggccatagataattgcacgttcagtaataacatcgcctgttgaaatatcaattttgacattgacaactgacgaatagactttagctttcacatgcattcgatagccactgtattcatcatcctcacgaatatcatccaatttaacgattgttagttgaataatgtcattgggtaattctatggcacaaacgtcttaaaacacttttttcatagtttctttagtaactggtaatccaacaattgaagtatcaatatctcgtgttgaacgtgtatccgttccgatcaacgacgcaattaaaaaaccgccttaaggacaaggttatcccgatattccgaatgtgcaattcgatctaaaatatcatctaaaacaacttcttgtaaaagaatttgcggactaatttttctttgactggccatttttctaattttggccaaaaattgctttttatcagaaaaatctaacttcataggagaacctccatatatttttgaattgcatcccttactttaaatatatccgcatattcagttaatttgggtatattttttcctcgcattttcgcgtaattattcatcgcctgtttgatcgtttcggcgtcggatcgatcccgtgttcgcaaaatatcacacaaagtacgctcgacatcataaactttaaccacatgcttccctggagtttcagttgttgttatgccaatctcaaaaaattcctttttctgccgataaatttttattggtgcgtctgttttagtactatatgcataaggcaatggaaaattcatttcatagatacttggcgtgcggtcaatcattccataaaggaacaatgcagtatccttaaaaaaaacgcctttcgaaagacggtattgtaatgcagcaatatcgtcaccaaattcaaccggatcaatatacacccctggtgccaatctttcgagttgcccatgagcatacatatttcgaagtactctaggtgatattcccattgaactggcctctctggatgtcatttgaccgccattttcatttaagtatttaataatttcagattgttgactcattcgattcacctcaaaaaatccgttttatactcacattatagcatgctgtgagtataaaacggataaaatgctttatagtttctaaaattgtaatatgctatctgtcttcaattactattagaaaacaaaaacagcttcatgtaatacaatgctagaagctgctttaatatcaataattttttattcccactcgactgttgctggtggcttgctcgtgatatcgtacacgatgcgattaacatgatcgacttcgtttacgatgcgaacggaaatcttttgcaagacatcccaaggaatgcgggcaaagtctgccgtcatcccatcaactgagtccacagcacgaatgccaactgtgtaatcgtaagttcggccatcgcccatgacaccgacacttttgatgcctggtaatactgtaaagtactgccaaatatcacggtctaatccggcctttttaatttcatcacgtaaaatccagtcactatcacgcacaatgtttaatttatcttcagtaatttcaccaagaactcgaatacctaaaccgggacctgggaatggctgacgccaaactaaatcggatggcatccctaatttctcacccaaatcacgtgcttcatctttaaacaaagtccgtaagggttcaatcaaagtgaaatgcatatcctttggcaagccacccacattatgatgagacttaattgtttgcgcggtatccgtgccactttcaatcacatcagtgtacaaagttccctgtgccaagaaatcaataccatcaagcttttgagcttcatcattgaacacttgaataaattcattaccaataatcttacgtttcttttcaggatcagaaacaccgaccagtttgtccataaaacgtttttgagcgtcaactttgacaacgttcaagccgaacttgccttccaagctatccatcacttgtttagcttcacctttacgcaacaggccgtggtctacgaaaatactggtcaactgattgccaatggctttgtgcaataacacgccaacaacactggaatccacgccaccagaaaggccaagtaagaccttacgatcaccgacttcttcacgaatctttttgatttgtaaatcgatgaaatcattcattgaccagttggcactcgcttcacagacatcaaaagcaaagtgtttcagaatttcattgccatactgggtattgcgaacttccgcatgaaactggatgccatagaatttccgtttaggatcttcaatggaagcaatgggacagttcttgctggtggcaactgaagtgaaaccatcaggaacttgtttgactaaatcaccatgactcatccaaacggtttggtgacttggtaagcctttgaataaaggtgtttgggcgtcagtcacatcgatgtcagcatgaccgtattcacggttatcggctgattcgaccttcccaccaaggttgtaagccatgagctgcatgccgtaacaaattccaagaatgggaatgccaagtttgtaaatttcaggatcaacacgaaaagcgtcgtcatcgtagacactgttagggccaccggaaaaaatgatccctttggggttgattttccgaatctcatccgcggtgatgttgtgggaaaggagaacggagtaaacgccaaattcacggatccggcgtgtgatgagttggttgtactgacttccgaaatctaaaacaatgattttgtcgaattgcgacaaatctaaattagccaagttgttcacctcatgattagagagagtgtcaaaaatagcgtttagcttctgagcatagcctagatactcgaatgattcgcttttggaatcgtttgagtatcgtagctaagcggaagaagctgctatttttggcacgtttactctataaatttttttaaaagttaagttacaaaacatctacgtcaattctatctataataaagcttaaagtaaagccagtttgaaatgcaattattccaaactggcttactaaacactaatatttccgtaaataaacggcatccattgcatgatgttcaaccttatgcaaaatcagattggcacgggaacgcgttgggaggataaattcatccaaattaggcagatccacactctcccaaactttcctggcttccgcaaaagctttttgtcggggccattgcgcaaattcataatagtagtcctctggattatgaaatgcggtatccaacaagattccgaatcgttccaagaaccatttttcaattaactctggatccgcatccacatacacggaccaatcaaagaaatcactgatataaatggtttgattggaaggtaactgtaagacgttaattccttcaacgatcaagatatccggattatccaccgtttcaaacttgcccgggacaatatcgtagctttgatgcgagtatagtggaacctgaattctggcctggccgtttttgacggcgcccataaaatctaagaggctcggcatatcataactttctggaaaacctttgcgatccagaattcctcgtttttccaattcagcattaggaaacagaaacccatcggtggtaattaactgagaatgtaatttcggaaagaaattagtcagcaacacttgaagcaaacgtgccgtcgtacttttaccaacggccacgcttccggaaatgccaatcacaaatggtacgcgtttttcaggtaaatccaaaaaatcggttttcgtagcttgccacgcttgaaagcttctgaatttcttaattaacaggtgaactaatggcacgtaaatatcctgcacatcctgcaaagaaatacgatcatttaacgctttaatcgccttcagttgctgacttgatagcggtaattttgcttcaggagctaattttttccaatcatcttttaaaaatcgatagtaactttgatcttcttctaccatttttatttcctcaatgactcattattccaaggtatacagtttggcacccacccggtccaacaaacgtgacatcttttcagttgccacaattgttaaacgatgcattgctcgagaacaaatggtgtacagcaactgccgttcatcttcatcatggtaagtggcgtcagatgcatcccaaacaatcactgcatcaaactcaagtcctttagctaagaaagatggcacgacgacaattccttcagctaaacgttgattttcagttcgaattaacgtcactttttcgccagcttcacgcaagccgttagtaatctcttcacatgcagctactgatttgccaataatagcagttgattcgccgtctttttcgttttgacggagttggtgttgcacacggttaattgcgtcccttgccttcgattttacgctaactactggcaactcaccttcccgttgaaaggcttcaattgcctcaccgtttgtcaaaatttctttagtgaagtctgtaatttgttgtgttgaacggtaagacttctcaagttgaatcacacgggtcttatccttatcaaacattgtggaaagttctgccagcaaggtcgttgtattttcattactgtaaattgactggttcaaatcccctaacaacgtgaacttagctcgtggatagttgaacttcaagtaagccaactggaaggctgtgtaatcttgaatttcatcaataaacacgtaacgcatatcccgttcaccctttttacccacaattaaatcatacaaatagaggtaagctgaagtgttattcagggagatggcatgtttcttcaggccttcaatcgtttcatctacataggtccgccaatcggatgccgttaagccaaacttatctaaacgcactaaatgaggaacgctgcgcaaaaagtgcacgtattgcgcattaatattgagaaaacgattgtgcacaattgcgttacgaactggttgaagtgcttggataactaatttccgggccaagaatttaaactctttatcactatcatcaaactctcgtggctcgccaccatacagtttttccagatcttcatgatttagggattgaacagcttgttccgcccatttagaacgaacttcaccgccaattcgatgattcaaagatttcaataaagtttctttggtcgcatctaaacggtttcctaaatggtagttttcattaaaactgtagtaaatatcatgtaatttatcttgatctgcaaatggcttttctctaaacatgaggttacggaacttcatgtccgctgtttccaaatgtttgccatatttagtgaccgcattaaagtaaaccaggctgttttctagacggcgaatcttcttggaaactggatctgttcggccttcaaaacgttgttgcaacgtttctacttccatgttcgggatacggcgttttgtaaattgataataagtcatctgaaccatattatgttcgccaagttcaggtagcacttgatcgacatagtcattaaaaatttggtttggtgaaaacataatgacctggctagcgttcaaattgcctcggtagcggtaaagtaagtaggctacccgttgcaaaatagccgctgttttaccagatccggcagctccctgcacaaataacagatcagaatgtgtatcacgaataatttgattttgttctttttgaattgtggaaacaatacttttcatcttggtatcagaagagttgcccaacgcatttaacaacatttgatcgccgatagtttcatcggtatcaaaaatcgtgacgactttcccattttcaagagtaaattgccgttttaatttgacgttcacttcttgtgtaccatctggtgtttcataggacacattgcctagtttgccgtcatagtacacacttgaaattggcgctcgccaatcataaatcaaaaaatgttcaggcgtatctgaaaatgatccgagaccaatataaatggtttcgtcgcttttttcgccctcttcatgaaaatcaatgcgggcaaaataaggacgcttttctaaacgtttcaaaacatctaattgctgactcgcatggcgccaactattttgacgttctgacaacaattgctgttgttggcgcacagaaatcgccgtatccatcattccagaatacgtactggtattcattcgaacttcattactaaagtttttatcaatcgctttggagtcagtctccgctgtggtcacatctttggtagccttttgaatggcctgttggatcttggcaattacttcgtccagatgtgcctgttcgtacttttgaattgaatctgtcatgaaacccctccaaattacttgttgtgacgataagtgacacaaaaattggaaacttcatgcgcgcaattttgccgcaaaaaaatctaataaattaagtaaacatgataccactcttttgcctacaactcaatcaatctacttcctatataataagtcaattatcagccaccctattaaattactcagaatgttagtgtggaaatcgtcaaaaatattgtttgtcgaaataacttgtgctatcctgactccaatcattatgttcggatggagtaactttaccatgaatcaagtttcgttactcattatgctatttgccgccttaattaccccaatgttaatggcgcggtttaaaatcaccttcttacctaccgcggttgtggaaattattattggcatcgtcttaggccccagtttgttaaacgtggtccacactaccggaattttaaaccaattatctgatatcggcgtgatcattttactatttttaagtggtatggaaattaatttcgatttatttaaaaaatccccaactgagctttcaccactcgcacaaaaaaatgcggcccaaaattcacgctggtcgccaattctgttgtccacacttgcctacttaaccattatcggcatttcattaggtctcgctggtatttttaaatggacaaatcttttttctgacttttggctggcagccattttatttgcgaccatctcgcttggcattgtcatcgcgactttgaaagaaaatgaattgctgagtaaagctttcggacaaacggtgcttctcatcgctgtgttaggcgaagtgattcccatgttagggttaaccttctacgcctcgttttttggtgacagcagtaaaagtctctggttgttacttttaattattgtcgtggccgtatttttgctacggcgtttcaaattctttttcaactttttcgaacaaattaataaatccacgacccagcttgatattcggctagcctttttcctcatcgtagccatggtcactgtcgcttcttcagtgggtgctgaaaacattttgggtgccttcattgctggcattattctcaagttgttacgcccaagtgaaaacacaaaagataaactagattcgatcggctacggattttttatcccgatctttttcatgatgagtggcatcgggttgaacctacgcactttgctaagtgatcctcaagctttgacgttgattcccttattctttcttgcttacatcattgccaaacttgcgatctatccaattttgaaattacggtttaaaaatatgaacgccgttgccggaacgagtttgtcgacagccaccattacgatggttgtggcaattttgcaggtggcaaagaacatgcacaccatcaatgcccaccagtcaggtgcctttctgttagccgccgttttgacatgtatcgtttcaccattaatttttagtaagacctataaacctgagccggaagatctcaaaaaacagatcgttcacttcattgggaccaatattttcacagtgccagttgcccagcaactcactcagggttggtacgatattcaaatgtacacagataatgaaaagaattttcgaacctataacagtgaaattaacgcgcacctattggcaagtttagatgctgaagaacttattaaacaaggggtatttgatactgacattttagtggttggccatttccgtgcgcaagaaaactacgaaattgccaaagccgcaaaagcttatgggattcggcgcgtcattgtgcgctttgaagatcgcaacttgttaagcgaacacgaaaaacagcttcgtgacctcggcattgaaatctacaacacgccagaagtcaacattgccatgctccgcggtttaatcgaaacaccatcgaccatgctgcttttgaatgaaacagaaaatgccatttttgaagttcaagtccgaaatcgaaaatatacgggaatggaaatcaagaatctatcgtttatcaataaaattaccatcagtcagatttttcgtaatcgtcacctaattcggccagtcggttcaacccaacttgagctaaatgatcgccttatttttactggcaataagaatgataccgaagaaattcggcgtgaattgggaaaaatgaattaattctcgttaccaataagacagttttcagagttctagctgaaagttgtcctattttttgtaagcgatgtcttacagctatagcatgattcttattaaatcagctcatattaaacacaaaaaaaggctataactacagtcatggcctgtgatacaatagctttcggacataaacgagaaaggagaatagatatgaaaacagtcgaagtttattttgtgcgtcatggtcaaacttttttcaaccggtataaccggatgcaaggttggtctgattcgccattaactgaacaaggttggcaggatgctaaagtaacaggtcagcgtttggcaaacattccattcactgctgcttactcgagcgacaccacgcgagcatttaacaccgccaacacaattgtccatagtaataaatctcccggactcactgtaaaacaattaccagagtttcgagaagaattctatggttattttgaaggcgctgattctgcgcaaacgtggttccaagttctgaaaccaattagcaaggcccgcaactttcacgattttttgatgaatcacgatattagtgaatctaaaaatgctgtgaaagctgccgatcccttccacgacgctgaggatcatcaagatttttggaaacgattggataagggctttaattatttaaagactcacagtcaggatcaagataagattttggtcgtctctcatggcacaaccattcgcagcattgtggctcgctatgcaccagacatggatattacaaccagtcccagcaacggtagcgtcacaaaattaaccattaaggattctcaaatttctgttgattattttaatcagatagaaaaaataattaattaaaaataggagaatttaaaaatgaaaaactcgcccctagacacaaataagcacttcatcagctggccagtggtggccctgatggatttcgtgaccgttatcggtttcgatgatttaatttacaacttccataatcaaggtttggcaatcgtcacaacttggattatcatgttacttctgttcgtttggccttacgaaatgatggttggccagctgggttccgcctttcaaaacgaaggcggtggcttatcttcatggattcgctccacgaatggtgatcttgccggctacatggtcgcctttctctactggattgccggtttaccttacgtagtcgatgttgccaactctgtggtggtttccatcagttggttagtcaaaggcaacggtgatttaaacaagtacatgtcaacatttatgtttgccattttcactgcaattattttccttggcttcatctggttccagcatttattcaaaaataagtccttggaaattatgagtactatcggtggtggtgcaatgtttgtcatgacaatcttgttcgtcttgatgacggttggcgctttgattcatggccgtcatatcgaaacccagcccttcaatttaggcgcctttatccctaaaattaatggtcattttctttccacgtttggcttattgatttttgccattaacggtgctgaattggcaggaccttacgtcaaacaaatgaaacacggtaatcgtgattttccaaaggccatgatgatgttgttgattatgactgggttcctcaccgtgtttggatccttctcattaggtgtcttcttcaatgcccatcatttaccctatgatttgaagatgaatggctcttactacgccttccaagcccttggaaaacaatttggcatgggcaacgttttgatgtacatctttgcggtggcacaatttatttatatgtgtgctcagttagccgtaattttggacgctagcacacgaatctttatttctaatgtttccaagaaatacttgccaaaacgcattacgaaactcaacgatgacggcctaccaatcaatggttactggttgaccactgctatcgtttcactagttttgttcttgagtaactggcttccaagtatcaacgacatgttcaactggttattaaatattaacggaattgtttcgccatttgtcacaagttttgtattctatgccttcatgcgcattcgtgctaaaagtaaggattatccttcagaataccgctttatcaaaaacgataaatttgcttggttagtgggtctctggtgtttagttatcaccttggtcttctctgtaatgggaattcgaccaaccgatgccactcccggaactgttttatatacaaaagaattaacgttaaacattgtcataccaattatctttattgccctttcagccgttttgccttacatggctaaaattggccgtgaacacctcgctaaacaggcttggttgtccacacctttggctttgatcgtgtttgtcatcgttggctttttcttagcccaacatttgaccaacgccggcaccgccatttcaattctttcttgggcactaaacgtggttttgtttatcattgtttatcaaatcgtgttcaaattaattacccgtaatcattcagtgaacgattaaagatatttgtttataacgcaaaaagacacctttaagggtgtcttttttgcgtacgctagtttttaaatgaatgaattggtgctggaatatgacctccacgcgcaatgaaatctgcggatgaagccgtattaactggcattactggtgaattaccaagcaaaccgccaaactctacgttgtcaccaactttggcaccgactgcaggaattacccgaactgccgtagttttattattaatcataccaattgcagcttcatctgcaatcatggcagaaatcgtcgaagctggcgtgtcacctggaatggcgatcatgtccaagcctactgaacaaacagccgtcattgcttccagtttttctaaattcaacgcaccactggtagctgcggcgatcatcccttcatcttcggacacggggataaaggctccagacaatccaccaacttgattacaagccatgacgccaccttttttaaccgcatcatttaacattgctaacgcagcggtagtgccgtgagttccaacagtttccaccccaatttcttccaaaattcgggcaacagaatcaccgacttttggtgttggtgccaatgataaatcaacaatgccaaacggtacacctagtcgatctgaagcgatgtgcccaactaattggccgacacgagtaattttaaaggcggtctttttgattgtttctgccaccacgtcaaaaggttctcctttgactttttccaatgctcgtttgaccactcctggtccgctaactcccacattgatcaccacatctgcttcgcctacaccgtgaaaagcccccgccataaagggattatcttcaactgcattcgcgaacacgactaatttggctggcgctaaaggcgacaacgctgcagcagctttgaccgcctctcccatatctcgaaccgcatccatgttgataccagatttgctagacccgacattaaccgagccacagacaaattccgttttgcttaaagcttccggaatggagtgaattaaaatctcgtctcctttttgatagcccttttgaactaaagctgaaaatccgccaataaagttagcaccaactttattagccgcccgatcaagcgcttgagcaaatggtaagtagtttgttgcattggtggctgctccaataatactgattggtgtgaccgcaatacgtttgtgaataatgggcacaccatattcagcttcaatttcgttggcaactgaaactaaattggcagcttttgtggtaatttttttgtaaattttgttgcaggcctgtttaatatccggatcaatacaatccaataaagagatgcccatcgtaatcgtccgaatatccaagttttcttcgtcgatcattcgtgttgtttcaagtatttggttagtttccaaattacggcacctccattaaattttgtacattgcgtcgaaaatttcttcacgttgaatccgaatctgcacacctaattgttgacccaatttacttaactggttacgaaccgattcaaaatccatctttgtcgccggcaactcacataccagcatcatcgtaaaatttccttccatgatagtttgactcatatcaacaatattaaactttaattctgccaaagcttggctaacacccgccacaattccaactctatcttgtccaaccacggttaatactgcacgcataaaaaggccaccttttatatttgatatgatttattttaattgattagttgccaaattgacatttttataaatagcgttacatcaaagctttaacgtcttcaattttaatttttaaatgcttcatcgactgctttaattgctttactttttcttcagattgaaccaattgatcttggagaatagttaatctttcggctactgttgcatccccctgctgataaattgccaaaaaatgtttaatctggccagggtcatcccacatgccttcacgcataaaataaaatcaatgcgatcaagatcagtcgcttcaaattcacgaatgccgttcacacgtttgacaggtcctataacagcccttcacgttcataatagcgaatcgtggttgtcgaaatattaaattgctgtgccactgcatcaattttcaattttttcacctcttgacttgaagtatacttcaagtagtagaatttacaataacgaaaacaattagggaggataatgatgatgaaaactttgtacttggtcaggcatggtgaaactttattcaatatccaaaataaaattcaaggttggtgtgattcacctttaactgaaaatggtgtggcacaggccaaaaaactaggtgatttttttaaaaatatttccttagatcatgcttatagttccacttcagaacggtgctgtgatacgaccgaacttattttgcaaaatcggcttgggtatcagcgcgtgaaagctctcaaagaacagaactatggcgtttttgaaggtgaaccagaatatttgagccctaaagcaccaaaagattttgaaacctttttccttccctatggcggtgaatcttcaaatgaagttggtcaacgcatgctgaagtgtctcaccaaaattatggctaagccagacaataaccaagtattagctgtgtcgcatagcggggcgtgtttcaacttcctacgtatgctacaagatccaactgaagaacttgcaaagggcttcccaaatggtgcaatctttgtttaccattttgaccaaggcaagtttcaattggctaaggttattcgcgaattttaaaacaaacgcaaaaaaaatcatccctactctcacaatgagaataaggatgatttttcatttaaccttcgctaataaccaataaagacttgattgcagtccgtttgtccattgcttcataagcatcttgaatatggtctaaatcaaagcgctttgtgaacactttgccaggattaatcttgccgcttaaaacagcatccaacaaaatatttttatcatctgttgtgacagaggcaatcccaccacgtaaaccaatgttacgccagaacagattattcgtattcatttcagctttttgagggacaccaacccggccaacaacagctcccgggcggccaaccttaacggctgtatcaactgattgttctgtacccacgcactcaagaacggcgtcagcaccactgccagttaattccattacccttttgacagcttcatcaccacgttctgggatgatgtcggttgcaccaaattcacgcgctaatttttgacgatcctcatgacggctcatcgcaataatgcgttttgccccgcgcagcttagcggaaattacgccacataaaccaaccgcaccatcgcccatgacgactactgtgtcgccttctttaacttcggcactggcagcggcatgataaccagttgccatgacatcagccaaagttaaaagtgagtttaattgttcatctgaataatcagcaggtttgccaggaattttaactaatccccagttggcattggtgtaacgtaaatattcgccttgatagccgccattaccaccagcttcttgattcaaacagtccccatcaaatccagctaaacatgcggcacaatgaccacaaccatgggtaaatggcacaatcacgaagtcgccggctttaatatcagaaacctctgcgccaacttcttcaaccaccccaatagcttcgtgaccaactagagaattagcttcccgtttggaaataccacggtaccaccataaatcagaaccacacacacaagcgcggacaattttaattaaagcatcggatggcttttcaattttaggtttatcaacctcatgaacttccattttgccaggttccataaatactgctgctttcaaagaatccatctcctaaatttttttaaattattactcaacatcataagcataaaccttggagtgcacttcaaggcaagttaattttaatttttttctttgctttaaattaattattctcatttttttgataaaccttatttagagaaattcgaataagatatggcaaagaatcaaaaattatggttgcgatctgtggagaactttgagaataatttgtgtccgaccaatgtcttagtatcattgtaaatccagcttgaaaagcaataaaataatataagaatttttggctactcattttgggatcataccgtttgaccggtgtcagtagtaaatcaaaaagacgatcaaagccttcttgaatcggaaaactgtctcgcaatttcagaacaattttataaaaccaaccattttcttttataaaattcaaaaaaataattaacgaactttgatcgaaaaaagttatcttcgatacatgagattgtcggacaaattccgaaaataatgcttctcgtttatttttctgagttgtgtcaattaagtcataaacatccaaataatgggcataaaacgttgaacgattaatattcgctgtatcacaaactaattgaaccgttattttttcaaccgaatattttttaagtagatcaaaaataatttcttgtagtgctcggtgtgtcttatcccagtgcttattatgcttttgcattatttgcctcttttttaagaaaatccaacacttattcaataattgatgactgactttatgccaatgaatagctaaacttaaatacataggaaactacgtaactgcgagctcaacaatagtaaggaagatgatttttttgaaagcagcaatttataaaggtaaaaaaacattgaattagcaactttacccaccccacatgctggggaaaatgatgttgttattcaaaatatttttgcaggaatttgtggttcagacgtggctgtctacaatcatggtacaaacactggtcataaagttggtaatggccatgaatttggccatgaagcagtcagccgtgttgtggaagtcggtaaaaatatatctgatttcacagttggtcaacgcgtatatccttatccgctatatgcacgtggcgacccgaaaagagctggaagtatgggtgctttctcagaatatattttagtgcctaatgcccagctcaatcattcattatatatagtacctgaaaatatttctgataaaaaggctgcaatgatcgaaccgtttactgtaggtacatgtaccgctcgtcatacacatccagaaaaaggaaataacgctataatctacggtgccggtacaattggattagcagccgctgtagccttaaaacattttggtgttgaaaaaataattgtcatcgatcattcagcttttagattgaatattgctcacaaacttggactggaaactattaattcaacacaaactgatgttaaaactcgagcaatagagatccttggcgctgcttttggattgaaaggtgattgccccaatgctgatatttttatggatgccgtaggtcgtaacgaaattctaaacgatttcattgagtttggaaaaatagatagtcgttttgtggccgtgggcgtaaacaatcaaaaacccgatttcaatttactagacttaatttatggttcaaaaagtattggtggatccggtggctatcggccgagagacgtaaaaacagttatggaaatcatgagtaattctaaatatgacctagagcaactaattaccgcagaagtcgattggcaacatcttgaatcaggaattcaacaagctactgatgttaaccatgcgctcaaagttcttgtgaattatcacaatagttaaaccctctacaaaagttaaaaattttaattaaaagttctcatagtacataaatatgttcactacgagagctttttattgattcaaaattcttctaaaagaattgattactcttcctttgcaaaatagcttgtcaaaaaatctgccacgccatcatgattgttatccaaaacggtttctcggttagccgtttgtttggcttcagcagtcccatttgccattgccacgccaactccagcacttgcaagcatttccaaatcattttgggcatccccaaaagtcatcaaattatcacgtgtccagccaaaatgtttcaacaatacatctaatgccgaccctttatcaatccccggttttaagaattccaaaatcatcggctgagaacggacaatatgaaattctttcgttagttgttccggcatatttgccacaatctggtccaaaacgccgggatctgtgcaaattactgccttactataggaaacatctggcatttttgtaaacggaatgtgcagaaaatgcatgtttcctcctaaccgcttttcataacctgataaaggcaaatcattaattggatacacgccgttaaaatctagaatatctaatgaatactgatttgcagcacaaaattcgtgcaaatgcgcaaaatgatcccgtttcatgccatcagccatcaatggtttcttatccacattgtgaataactagggagccattgaaattaacggaataatcattttcatccattaaccccagttgcgtcagccaatcccaaatggcattaattggccgtccagtacacagcacgattgctttcccctgtttgtgcaattgcttcaaaactttggtatttgtttcactaattttcttttcagaattgagtagcgtattatccaaatccagtgcaatcatcttaatcacaataactacctcctgctttcaccgctggcgaacataaactttatgaaaatttcttaaagttctggtttttcattttagaaagcctttacattatccgccaactgttccatcatatacctgtacccaataatttgaaaagaggcaatatgaatgattacgattaaaaacaacaaattagaagttgaaatagaccagcttggtgctcaagtgactcacgtggtggacgtcaaaggtaattttgattacatctggaatggtaaagcttggaaacgccacgcaccaattttgttcccctcaatcgggcgatcaaacgatgatcactacgttgtggatggtcaaacttatccaatgcctcaacatggttttgcgcgtgatttacaatgggaaaatattcgtaaagccgacgaccaagtgttacttcaattaaaatctagtcccaaaacaaaggaatactacccatttgatttcattttacaggtggactacaaattagttagtaaccaattattaacaaaatacagcgtcaccaacaatgacaaacaaacgatgccttatgcacttggctcccatccgggtctcaatattccaattgacgacgatggtgtgtttgaagactacactttgacatttggaccacatccaaaggaaattcaacagttaggcattaaccccgctccattccgggatggcacaaaagccccattcaaggcagtggatagcgatggtgttttgaaattagatcacagtacgtttgacgatgggttaattattttggatgccaaaaagattgaaacggtcactgtccgttctgaccaaaccgcgcatgaaatcaaattaaatgtgaaacatttcccatacatcacactttggactatggaaaatgcgaccgaaccttacctttgcatcgaaccatttgcaggtctccctgatcaagcaagtgataccccaacagattgggctaacaagaagggcaataacttcgccgaacctggcgaaactcagtcctttgaatatggaattgaattttcataatccgctttttacaaactaaacatgttaaaataggaacagtgcgattgatgcgctgttctttttatcttaattaatcatataggagtgttctcatcaaaaaatttactgtttacctcattcgccatggcgaaacttatttaaataaattcgatcgtatgcaaggctgggctgatgctcccctgacccccaaaggcattcaagatgcgcatatggccgctaaaaaagtgcaaaatgttcactttgatcaagctttttccagtgatctcactcgagctgttcatacggccaacatcattttgaaggatacgcacaacgattcgttggatgtgacccaactcgcaaacattcgagaagccttctttggctactttgaaggcgccaatggtcccgaaacttgggataccatttgtcgcccactgggatataccggcattgatgatttcttgagcaaacataccttttacgaagcacgagatgccatgcatgccgctgatccgtttaaagatgctgaagatgcagaaacctttaaaaagcgaattttgactgggattgatcaattagccgaaaaagctaatgacggtgaaaatttattggtcgtttcgcatatggatgccattcgcagtctaattcaattgctgaatccccaaattgatgttcatttaccaatcaaaaatgggagtctcaacatcttgaattttacagataatcaggctgaggttgtggcttacgacaagtaggtcgaactcctttgggcaagatgttttgcttctgtttccactcgtgagacaataaagaaaattggaaagcaggtggcaaaatggctgaagaacagcaaaccgacatgcccgcatgtttaatcgaacctacgggtaaagccaaagtggaacaagacaaactaagtcgtattcatgacgagttggtaaaccgccaacttgcagaattagggattgccccacgaaagttatccgttaaaaaatcatcataagcttgaaaaacgagggcaggcaaaaaactatgttttttgcctgccctctgtatatttcttcaaatattatttctaaaatgttggaaaaaaggcagattcttccgcttagctacgactaacgaatgatccaaagtacggatcattcgttagtctaggctatgctcagaatctaaccgcctttttgcccactctcctcatttttaattagcatttttttgcttaatcgccgtattcacagcatacaataacaccagaatggcgattcccatcagaattgtcaagactaacaaagcgttgcgtgatcccacagccgttaaatcagcctgtgatccgcccttacctaactggctagcaccaattattgtggaaacaattgacgttccaactgcacccgcaaactgctgaatcgtgttcaaaatggcattgccatccgtttgctgctcgttttttaaggtggacaacccattcgtcatgatattgccaaaaatcgaaccaaccccaaacatgtagatgacataaattgctaaaatgaggctatcttttatgtttaaagctaaaactgtaaataacaccaggcaaataaaaacaattgagctaccaagcatcaatggttttttcgcgccaaaatggtcataaattcgaccactaattggtgacatgactgcgcctaaagcagcacccggtaaaaccactaatccggcaatggtagatgttgccccatttactaattgcatatagttgggcaaaataaatgacattcccaaagaaattagctgtaaagtaaaaaacacaaacacatgggctgcaaaagacgcgtttcctaacacacgcaaatcaatgacaggctggtcaatgtgcaaactgcgatagaccaaaccaactaagccggccaagccaatgataatggcaccggcgactggcaaactcataaaactcatcccacccatattactgaatccaagaatcaacccaataaatgtcatggcaatcaacaaaatactgaccggatcaaatttcatagcttgcgttggccgtttttgttcaatcgttttgatccctgttgctagcgaaattaacagtagtggcactaagatgatgaacacaaatcgccagcctaaactcgcaactaccaccccaccaaatgtaggtccaattgcaggcgcaacagcagtgattaaagttccaatacccatcatcatgccaattttgctggtcggaacttgatcaataataatattaaacatcaagggtaaggctattccggtcccgcaaccttgtataatccttccaagtaataggatcggaaaaattggcgctaccgcatccattattaggccaagcaagaacaatagattagctacaataaacaaagatttggttttaaaacgggtttttaaagctgacgagagcggtacaatgattgccacagtcaataagtatcccgttgtcaaccattgaaccgtacttgtggtaatatcaaattctttcatcaaagttggaaaggtaatgttcatagcggtttcgacaatcacgccactaaaagacatcagcccagtagcaatgaccgcggcaatcacctgaggccgaattcgttgattagtttcattagtcatattttatttctcgtggtcctttccataattcttaccagcttcatcgacggttaaaaattgcaaaatctttgtaaaattttcaagttcttcagcagtaaaattagcttccaaactagctcgttgaaccttcatatagtttcgattaatttggacaaagggttgtgcctttgctgttaattgaatttgcttttgccgggcatcatcttttgcaactagtcgtaaaattagtccctttttttccatccgttgtaataaggttgtcgcactggaacggcgaatggcaaattcattttcaatatcgcgttgaagacacgtttggttaggatactttcctagaaaatcaataatggacatctggacaccggtcaactcatactctgcggcaaacgtgtcgatatgccggctcatgacgttacttgcatgtttaatcaggcgtccatacatagataaatcctgtttcatcagtttcatctcctcagcttccgttagcaggctaacgttttacattatagaactttttttaacgattatgcaaggacaagttaaatgaaagcacaaaaaactgcaagtacattgcatcattaaaaatgtacttgcagttttttaccttgtgactaaaggttgaaagcatcaaagttattatatcagtgtgttgattgcaaagattagacttagtctggaagcaaatggactcagtagtgtcctttatcttagcaggtttcacttagataaaagccgagcttggagacgtggcttgcggcaccaagtcgtgcccactattccgcctagtaatgatgattttcgttccgaaaatcttttttgctcttttccaagtattcattgtgatcgttagttagtgattaaccatgccggtattaggaacttcagaattcaaagtatcgtcaatcggattgtcatcaatgacatccagatgttcattctgcttgagatcagtttcacgtcgttccaactctttgacaatttcggcatgcttctcgtcagtcaagtcgtaaccaaagtaaaagacaatgcaggaaatcgcactggcaatcgctggaactaagaaatacacggcactaatgccggagattgtgctggcagattgaggttgattggcaacgtatccagtcattgtcaaagcaagaccaggaataaagccggcgaccccttgggcaattttccgcacaaaactgtagccggaataaataattccttctgagcgaatcccggtttgcaactgaccgtattcaatcacgtcattcacaaacgcaaaggcgacggtcccactaaagcccaggaacatgtatgaaatcgtgttgacgatcagataaggaacgacatgtgagccggtgataaaaaagttgaccagttctgctgcaatgaatcccagtgttgcgtatattgcaacgttcttcttaccaattttcttaaccaacggcgtggcaaagatcaccgctggaataatcgataaagcactcaataggctcacaatactaacgattccgacctgtcccaaaacgtactggaagtagtatagttgaatacccattttaaggaacatcgagccaacactaagaatcgtgaaaatggatagaataatgaacggacggttggttaacagtcccttgatcgacttgagaccatcccccttttggcggggcttatggtcaatgatgcgttccttggttccggagtaacagagaatctgtgaaacaacgccggcggcagcaaaaatcgcgaccgtggcaatgtaaccaattttgggcgtcgcaaagatcgctaccagtggaattactactgctccggtaagcaaggcggccatttgtccagttaagttgcgagcggcagccaaagaagtccgatcaccggaatccatagtcatagctgctgccagcgaaccataaggaatatttacaacggagtaacaaaatcccatgatgttatatgaaacgaaggcatagatgatccgcccggtctcaccaaaattaggcgtgacaaaacaggcaactgttgcaattcccaggaataatgagccatagagaatgtatgggcgaaactttccgcgtttggaaatatgctgacgagaatccacgaaggcaccaacactggtatctacaaaggcatcgaagaatttggcgatcaggaaaatcaaccctccccaataggctgggatctgtaaaacatcggtatagaattttagtaagaacagctgagcaaattgaaacatcaagccgttgcccaaatcccccaatccataggctactttttcacgcattttgagtttttctgttttcaaggtaaacccctccttaatcatgtgctggttcttagtttgttaagcgctttcatttgaagcaataaaaaaccggcgcacgcggaatcacgtgttccggttcgaaaattaacgatattattttttataaccaaagttaggaatcttagtccagcggtctttcaggtaacggacaaccatcttcggttcccgtgatctggtgaaaattcctttcttattaccctgaacccgttgaatgccaaatttggtctggaagtcggcgaagttccacaattgctcaccgacaaagtgtgggaattcatcgaagaccttgctggccattcgatagtagtcttcctggaattcttcagagaatggctcgtcgtaattgctgtggagcccaggaatggtgtcggcgccgtattcggtatacataatgggtttgtccgggaatttgtcagaatattcctgcagctcatcgcgggttgcttgttcagccgtcttcaaatcgccattaccaacataccagccatagtagcggttcaaggcaatcacatcaaccaatgaaatacagttatccgtcttcggagtggccatcatgatgctggtgtaggtgcaaggtcgcttttgggggtccagttgacgggcttcatcaaataacggcttgaagtattcatatgccccttttgaaaaggttgccgcttcgttggcaatcgaccacatcgcgacacaggcatggttcttgtcacggtcgatgatttctttgatcacctgtttgtgggcgtcggcggtctttaatttggtccaagtatcgtcttggtagtcgtcgctctcaagcattgacacatcaaacccaaaggtcaccatcaacccaacagctggcgtttcatcaatcaccacaattccttcgcgatcacataaccgcatcatttcctcggagtatggatagtgggaggttctaaatgaattagcgcccatatccttcatcaaattaatatccaagacattgaccggttggttgatgccccgaccatgaacgtatgaatcttcatgcttgccaaagcctttaaaataaaatggttcgccgttaattaagaactgggcattcttaacctcaatcttgcgaacaccaaagtcttctgaataggtatcgatcacttcaccatttcggctgactgtcacttttgcggtatagagataggcgttcaacggctgccaaagatgaacgtggtcaatatgcaaagtagtatcggcagaagtgccgctgaccaccgcctggccgtcttggtccaaaatggtcactttaactccatcaatctccccgtgggtagtgactttgacctcgacgtcagcactggattcagccagatggacgtctggaacgaccgtgatatcgctgatatagtcagctggcgttgagtagattttaactggtcgttgaagaccggcatagttaaagaaatcaaagttttcgtcaacgtggcggagcttgtggccatcttggtcagtgctttccgaatagttgccaaccggcagagtcgtgtaatcaagaatattgctgagtttaacggttaagcggttgtcgctatcttttagataatcgttaatttccacctcaaacggtgtaaagccacccttatgatgggtaatttcctggccgttgaggtaaacccaagcttcatgagtggcggagccaaatcgcaaaactaaccgctggctgcgcaatggtttggcaatatcaaaattagtttcgtaccacacaaagccgttgtgctcacgaatcttctttgacgcggtttgatcattgaaggaagccggaaccgaaatgacgtcttcagttggcaacggctgtttgggatcgattggtgtgatctcctcatcgatcataaatttccagagtcctgataagtccagaaccgttctgctgggtgttgtgagtgggtataacatagttaaaatcctccgttcgttagtcagtatttggatcactgcttttcaatgtctttaatataggctaaactgggatcgaatacttatctaatttttacttaaatcgcattttattgacttttatgtaaccgctaccagaaaggatcttgacgatgaccgcgtatgataaccaatcaactgctgaactgattcattccctgacccaaattgatattgccatcattcaaaaagacggcacccccgtggtgcaaattcaagaaaacgtgttaccagccttccaccggctcaacgagtttgatccgatctttcaacaaattgagcaattccatgctaatgggtacctgacttacacggattccgcccagctgagctacgtggcggcccgccttgaccaacctgacgaccaagttgtcgtcttgggaccgttcctaaccaccaccctgaccatcgatgaaatcaatgacatcgtggcgatgaattcctataccatcagcgaacatcggcaactcacccagttgtaccaaagcttaccggtgctggcagaagataaaatcaacgacttggccactttgatgaccaacttattttcccgacagctagccaccgcccacgaaaaagccaaagtaacccatggccctcagccaattgaaagatcgttgatgacggttaacagcgatcatcgggcgcaaatcgaagccaactatgccaacgaagccaaaatcaccaatgcgattgcctcaggcgatcaagtcgccgtccaccgtctcaatacaaccatgaccaagatatttgattccttctcgaatcgaattccaggcaagccattacgctcctcaaaaaatatctgctttgttttcaatactatttgtcgaattgccgcgcacaaaggcggcgtccacccggtctacctcaacgacatttccgaaaagtacgccttgttaatcgagcgccaaaacacgcttcaaggtttacacatcttagtccactcgatgacgcgggaatattgccaactggttcttaccctctcaacttccggctattccccaatgattcaacgagcggctgactatattctgctgaacctggggcacccgatcacgctcaatcaaattgcccaatctatcggcaccaatccgtcatacctttcaagaaaatttaagcaggaggtcggcatgaccatcaccgattacgtcaaccaccgccgcatcgttttggcaaaacaatatttgagcagaccaacgccctcgattaccgacatcgccttgatgaccggattcaacgatttaaattatttcatcagagtttttaagaagctgactggccagaccccactgcaatttcggcaaaagccgaccggttcagggattcaaaagtaaggtataatggcgttaacaatcatttccaggaggtacttcatgaaaattaatcagtttgcatatgttcccactgatcatcacactattgtcaaagagttggcggatgtccatttcttaaccgcccaaaccaaaaagatggcagatccggtcatgctttatcgccaattcctgctgaaattcttcattgaaaagcagagcttggccacccggattcaaaaggttgctaatttgatggcaacccccactctaaatgcttatgagttcacgacaactcaagctgccgtcagcaagttagccttttataacgttggcttgcagctgttgggatttgaagtcggcctggacttcgagttgaacgacccgttttccgccatgaaaaaatatcgactgccaatggcggttgtcgacgatacgctcgaccgcaatcaggtcattgatgcctggtacaaactgctcaatacgcgaaccaagtttgggcaaaccttgattgattatttggcgggtcaaggctactatcaccaattcttcggaaccgatgaactgaaacggccgctcatctttaacggtaagtcccaggcggtctttgataccactcaactcatccgcgacgtggtttacgttgaagcgcccttggacaatgaccatgatggcaaacgagacctcttgaaagctgaaatcattcgtccgggagaaactgaaaacggcttgaaggtaccggttattttcactgccagcccttacgaccaagggactaacgaccaccaagccgatcaaatgacccacgacgttaatcaggaaaaattaacccgcaagcaacccaaccatctgagttatgacgacgttaagttcgattacgacaaccatgacttgccggagccacggaccatcaaggataccaacaaagtcgctgaagaatcatttgttaaaacctggacttattcattgaatgattacttcttggcgcgcggttttgcggtggtctattcatccggtgtcggcactaaagattctgacggcgtccggacaaccgggacgcctgacgaaaccatcagtgccacttcggtcatcgagtggctgcatggcgatcggaccgcatttaccaaccggtccgatcaaattgccattccggcttggtggtccaatggtaacgttgggatgaccgggcgctcttatcttggcaccctctcaacggcggccgcaatgacgggtgttgacggactcaagaccgctgtggttgaagccggcatctctaactattacgattattatcgagagaacggcttggtcgtcgctcccggcggcttccaaggtgaagatactgacgtcttgggtgaactcacctttagtcgtgagcagtcggctgccgattatctcaaaatcaaggacacttggttggcccagttgaagaaactcaccgccggccaagaccgggtgacaggaagttacaacagtttttgggataatcgtaatctcttgaagaatgtcaatatcaaagctgacatgctgctagtccacggtttgaatgattggaatgttaagttgtcccacgtttacaatctcagaaacacgttaaagaatgaaaagattacccaaaaattagtccttcatcaaggacaacatgaatacctcaacaactttcgctcagtcgatttcacggatatcgtcaatctctggctaactaacaaattgttggcggtcgataatcaagctaaccagattgtgccggatgttttggtacaggataacgctgaaccggaaacgtggaacacctacaaagactggggcggcaacgttaaagaaattccccttgacgataagcgctggacagatctgaacgagaaccattcatttagcgatcaattgccagacgatttatttaaggactacatcgaaaataccaagaagtggcagaaggccctatttaccaagaatcattccaagcttgataaacacagtattaaactcgtgtccgagccactggaccaagatatcaccgtggatggaagagcgacgattaccttgcgggctgccagcagtgcggacttaggcttgttgagtgcggctctggttgattatggggtcgaaaaacgtttgaccgctgtcccccaaattttgtctgcccagcagattattaccggttaccaatggcggaaagacgatttgaaagaatttttgcctgagaaaaaagcatcggcttacaagaagttcaccgatgcccatatgaatatgcaaaatcgcaccaacaattatcaatcggacgacctgaagcccggccaatactccaacttcaccatagcgtttcagccaacattttggcgcttgttgaaagggcatcaacttggactgattatttacgccactgatatggactacaccatccgcagcaatcaggatatttcctacacagttgatctgagcgcttcaaagattgaattaccattgttgactgccgatgataaacagggataaatgtgatatgatttttataaataacaataaggataggtgattttatgaagacaggaacaaaaatcattactttggataacggctatcacttatggaccaatacccaaggcactggcgacattcatttgttagcattgcatggcggccccggcggcgaacatgaatattgggaagacgcagccaaacaactcaagaagcaaggcttggacgtgcaagttaccatgtacgaccaattggggtcatggtattctgacagtcctgatttcagcgatcccaagaaccgcaaagatattttaaactacgattatttcttaaatgaagttgacgaagttcgtgaaaagctcgggttggacaacttttatctcatcggccaatcatggggcggcctgttagttcaagagtacgctgccaagtttggtcaacatttaaagggtgccattatttcttccatggttgatcgaattgacgattacaccaagcacctggaagaagtccgtgagaaggcattaaccccagaacaagttgcctacatgaaggattgtgaagctaagggtgactacgataacgacaagtatcaatcatacgttgatattttgaataagggatacattgaccggaagcagccttccaagctgtcgcatctgatcgatgttactaacaccgatatctatggcgctttccaaggcgataacgaattcgttgtcactggtaaattggctgagtggaacttcaccgatcaattaaagaacatcaaggtgccaacgctggttacatttggtgaacatgaaaccatgccaatcgaaactggtaagcgcatggccaagatgattccaaacgccaaattcgtctcaacaccagaaggcggccaccatcacatgatcgataatccggatgtctactatgaccatctggcaaccttcatccgcgaggtggagaatgatacgttcaacaagtagagtgtgacgagcaacgggtgatgcggtgtgtaaggccggaaagattgaaatcccgggcttggatttaaagctttttggacttacacgttagcatcagttgcctcggaacacatttcaaccagagtgtgacgagacccggttagagcccggaacaatctcaaaaaccaaacaagcgccgggagaattgcatgtcatttgcaactctaccggcgcttgttttattttcgcaatgaatctctctgaagtaatttaattggcaaaacatacttatccagcagttgatcgtcatttttctgaaggcggctgaacaacaagcgaaccaacaaatccgcgatgtcttctaccggctggacgattgtacttaattctggatgatactcctggacgtaatccgagccatcgtagccgattacttgaacgtcttcggggactcgcatccccgcccggcgcgcttcttgaatacatagcaatgcggtttgatcatccgtacagaaaatgccgtccggctgatcagccagcagtttttcacgtaacgtagcccgacgaatggtgggcgtcgaattaaacggaaaggccaccatttgaacagaacagccatgttccttggcaatttgttcaaagccggttaatcggcggttattgggagcccgcttctctaaactaccggacacgaccatgaactttttggagcccttttcgatcatcgtccgagccgccagttcaccacctgcctgattatcactgctgacagtcggaattttcgtttgaaaataacgatcataggaaacaatcggcagccccgacattttatattccttaattccctcgttatgcgaaccagtgatgataccatcaacctggttagccatcagcattttcaaatactgctgttccttttcgggattgtccatactgttacagataatcgctttatagccacgggcaaacagccgattttcaatttcctcaaccacttgggcaatcaatggattctccaggctggcaaagatcaagccaactaatttaaattgttttccttgaaggacccgggcggccaaactaggttggtaattcagctgctgcatggcagaaaagaccttttctttggtggcggctgacaaatagccccgctcattgatcacccgagagacagtggtcacagaaacaccggccaactttgccacgtctgctaattttggttgcatgaaatcaccttctcaacgcgttttgatagtaccagtatagcatattggaaaatctttttatgttaatttatgtcaagcgattgacacatcgttatgtaagcgtgtatcatgtgttttgtgaaaggggtttcaaaatcatgagaggtgagcacattgattaataatcaacaaaatccgacttggtggcggaatgcagttggctaccaaatctatcccaaaagcttttatgacagcaacaacgatggtatcggtgacctaccgggaatcattgaaaagattccctacatcaaatctttgggagtgaacttcgtctggctgtcgccattcttcgcatcaccaaacatcgacaatggctatgacgtgtcagattatgaagatattgacccgcaatatggcacattggatgacacatttaatatgatccggcagttccatcaaaatgacatttgggtcgtcttcgacctcgtcatcaatcatacgtccgatcaacaccactggttccaagaagcgaaaaaatcgattgataacccctaccatgatttttacatttggcgaaaaccgattgccgaaaaagaacccaacaactgggtctccttatttgggggttcggcctggacttataacccggcgacagacgaatattattatcatctgtttgccaagcaacagcccgaccttaactgggaaaatcccaaggttcacgaagcggtcaaacaaattattgactggtgggccaaacacggcgttgacggtttccgattggacgccatttctcacttaaagaaaaatcaatcgtttgccaacgtccaggatcaagaagcagccatgaataacgttccaggcatcgacaagtttctcagtgaactcagtgctgattttaaacgggaccacctcatgaccgtgggtgaagctggtggcgttccagtcacccgcgcccaggaatgggtaaacagcaaaaccggctacttcgacatgatcttccagtttgaccacgtcagtttctgggaaaagttcaccgtcggccaaatcgacgtggcaatgctgcgaaaggcgttaaccaactggcagaacggcctcgagggaatcggctggaacgcccttttcctggagaatcacgatttacccagagcagtttcttatttcggcaatgatggcaacctgcgtcagcaaagtgccacggccttggcaatgatgtacttcttgatgaaaggcaccccgttcatttatcaaggccaagaacttggaatgagcaacgtggactttgacaacatcgatcaataccgcgatctggattccaaacgcttttatcaagagaaactggccaagggcgcaaccaaagatgaaacgttgtttaaactccaaaaaaagagtcgcgataacgcccgtacgccaatgcagtgggcgtcaaccggcggcttcagtaatcatcaaccttggatcgaaatgaaccccaaccatcgaaccgtcaatgttgccaacgaacaagccgatccacaatcagtcctcagtttttacaagcggttgattgctcttagactaagcgatccaattttactgactggtaagtatcacttaaccgacacgcacgatcatcaactttatgtttacatccgcgaatctggtcaccaaggctacctggttatcaccaatttgagtgatacgccggcaagttaccagattacctcggattatcggaacctcgagttaattctcactaacagttcggctgaacagaatcccgccgccatgaagctccagccctggtcagcctacctttacaaatacgaaaggaaataacccatgaaattaaacaatcaagcaatgctcattacctatcccgatagtttgggaaataatatcaaagatttgcaaaaagtcttgtcaacatacctggacggtgtcgttggtggtgttcacctgctgccattcttcccgtcatctggtgatcgcggtttcgcaccgatggattataccaaagtggacgaaaaatttggcaattgggacgacgtgaaaaagctgtccgagtcatactatttaatgtttgacttcatggtcaaccatatttcgaaacaatccaaatactttaaagatttccaagctaaccacaatcagtctgcttatcgggatctgttcatccactggaatgaattttggcccaagggtcgtccaactcaagaagatgttgatttaatttataagcgcaagccaaaggcccctgttcaaacggtcaaatttgccgatggtcagaccgaagatgtctggaacacctttggtgaggatcagatcgatctgaatgtgacttccaaggtaaccaaacagttcatcaaagataccttgaacttcttgatggaccatggtgcttctatcattcgcctggatgccttcgcttacgccattaagaaactcggcaccaacgatttcttcgtagaaccggaaatttgggatctactgaaagaaatcagtgacatcactagtccacgtgagaccaccttattgcccgagatccatgaaaactaccatattgtccgaaagattaccgaccatgattacttcagctatgactttgccttaccaattgtcactttgtatagtctttactcaggcaaagcaagtcgcttggccggctggcttaagaacagtccgatgaaacagttcacgactttggatacccacgatggcattggtgttgtggatgccaaagatattctatcggacgaggaactggattacaccaaagctgaaatgtataaagtcggcgccaacgtcaaaaaggtttattccagtactgcttaccataaccttgacgtttaccagatcaataccacatactactcagctctaggggataacgatcacgcttacctgcttgcccgcgccattcaagtctttgcaccagggattcctcaggtttactatgtcggcctgcttgccggtaagaacgatctgggcttgctggaaaagaccaaggaaggccgcaatatcaaccgtcactattactcattggatgaagtggctgaagaaaccaaacggccagtcgtcaaagcattgtttgatctcctccgtttccgtaatcagagctcggcgtttgatttggaaggtggaattgacgtccaacagaatggtgacaatgaaattgtggttacccgccgatccgaagatggtcagacttccgcaactttgtccgctaacttgcagacccaagcctttaccattacggaaaccaattctgaaggcgagactaaagaaatattaaccagtaatttgtcagcagttaaataagcacacacactgaaaagaggattaaaaatgaaaatgacacaaacattgcctgcgggttcccaatcactcacaaatgatgaacacattaccaacaaagaacgtttaagctatggagcatcggactttgcctgcaatatcgccaacggtatggtcggcacctacttgatgtactactacacggatgttttcggcttagctgccggggcaatcggaaccctgttttttatcgctagaatcgtcgatgcaatttccggtccaacctggggcattatgattgatcgcacccatacacgttggggtaaaagtcgccccttcttcttatggttctccattccatacgccatcttcttcattctggcattctcgtccgttccactaggaccactgggcaagttggtttgggcatacgtcacctatattgcaattgatattttatatttgggaatcaacattccaattacttcaatgctgcccagtctgaccgccaatccacaggaacgggttcgattcagtactgttcggcaagtgttagctaccactggggctacgttaatctcaatcatggtcctgccggcagtctcgctgcttggtcaaggtaatgacaaaaaaggtttcttgattaccgcgattttggtcgcaattctgactgcgttcttattgttgttaacgttcaaaaacacacgtgagcgtgtccatccccgtcaccaagaaaagctctccctcaaggagtctgctcgggcgcttaagggcaactggccttggatgattatttccttaatgtatttcttcttctggatcgggatgcaaaccaagcttcaagtaacggtttatttctttaaatacaatatgcacaatgcggacttagcttcgttcatgctcggtctgcaggcactctcgctggttgtgattgtctttacgccatttttaactcgccactttggcaaaaaaggcacgatggtaattggtcttggcctttgcgtcatcagtcaattagttcttggcgtcggtgctaagatgatgaacgtccccattctggcgggcgcgacgattctcgggtactttggtaacggcttcttcgctggactgctgccagttatgcttgccgataccgttgattacggcgaatggaaaaacggtgttcgagctgagggtctggttacgtcattctccggaattgcctccaaccttggcatgggaatgggtggtgtcgtcactgggttcttgctcagcatgaacggctacgttgccaaccacgcccagactgcacaagccttaaatgccattgagatgaacttcgtttgggtaccattcattggatttggtattggattaatcttgatgtacttctacaaattcgataaaatgcaaccgcaaatcgaagcagacctcaaggcacgacatgaagctgcttaaaccacaacttaccatttgaattaataaaggacccctgaagttagtgtacagatgctagcttcgggggttctttgactgttacaaatatgcttgataacccaagataattgccaagacaaccgcaaatatccccactgcggttttgataactttagatggaatataccgcacgatgatcggtccaatgtagccaccggtaaataaccccagcaacaaggggataatcactgcccagtcgattggaatcgtgaagataaacatggttgctgccacgatattattcataaacgaagcaaaattgcgcattgaattataaatggcatagttttcatgaacaatttttgaaagcaccgcaatcattaacaatccggatgccgcaccaaaataaccggtatagattcctaccaggaaagtacttacccagcttacaacggtaataattcggctatcaaatgccgatttgccatggcgtttaggcgtcaagatcagaattccggcaaacatgatgaaaactggaactaattttttgaaaccgctattggtgctatgaattaaaatgagcgcacctaaaacgccgcctaaagtatttaaaatcgcaatttgaaacgcctgtttccagtgaccatgcagctccctcaacgaggaggtcacggttcccagtccgccgccgacttgggcaacggtaatcgttgcgttggcagtaatcggtgccacgccaaccgacagtaataccggatacaaggtcaacgatgccatccccacaattcccgttaagactcccgctaagagactcatgagcaccaaataaataattgaaagcatacttttcctttcgcatcacaggcaccgtggtttttggctacgcctgcacataccaatatttgacttaagaataacattctggggttggaattcaaacgttaacgcggcttctggctgtcgatacttatgtaccagggaagcagctcgccggctacttctctgacaattcattaataactcacatgaacatactttggactagccgtcacgtagccaccctttacttggaaacgttgacttccagtgaccctcagagaataaggatgggcataaacaactttgttgactttgagaatggtgcccgttttgagctgtttaacatgtttatcgaagttggtgttgctataaagataagtggctttaacaatcttcactttctttggttgctgatatttttcagccgtgaccattttacgattaccggtgacatagtggccatttgaaagcaggtatcgggttgtcagatggtatttgatgaatcccttaactttcaatttagtcccttgcttcaaatttttgaccttcccggtcaagttcttgtgcgtgtattcgttgactccagttgggttaatgaccgtcagctgttggtgattgctttggtaataaactggacgaacgaatgcccaatcgctagtaatgtagccagtcttgccagctgttgtgctgtgatggttgacgtctcggacagcgtacacaatctggccgttacttgccttcacctgtttggttaccacaaacatcggccgattaattcgtggcttcttggtataggtggcgattcggtcacgtgactgcatgtctttgtccttgtacaagttgatcgttttcactgcgtatacagcttgattcttttgtgctaggggatgatctggggttggaattgcaccgggttgcgaaactgcggtggttggactctctgcggcccctatcgattcacttgagcgatttggtgttggggtagtttggggatttgttggccgtggttgactgggtttcaccggtggaacgactggaatctcaggctgtttaacaactttgacaaacgcacctaagtcgtacccacccagtcgatgaattggctctggattggtggcgttctctcccaagccatcattctgctgagcttcatagtgcataatgaccgtaaattgatttggggtgtcggcaggctttggcaaatctgtcatctgtcgtttgttctgatcgttcttaaccttggcaacagtgacatccgtgtcgtttgccaacacatccacatcaacatggtcggggttaatttgttcaactccggcaatcttgaatgaggcattaattgtctttgttaaagctgcccatgtcagtggatccttggtcaccacatctaccgggagcaaatctttagaaacaagaactaaatggttctcgtcaggaccggttggaatctggaattgatcaccaaaggctcttgcactcatttcaatgtccgcctggccaagtgagatgctcgtcaatcggttttccgaaaatgccccagtcgcaagttgggttgccttgggcaaatcaactcgtgtcagtttattgttggtaaatgcccacttgccaacagtttgaacattaggcagtgacacgctggtcagttcgttacccgtaaatgattcgtcgccaattgtggtcactccaggcaagtcaatgctggtcaactgattgccatagaaggcattataatcaattgtcttaatctggtttggcgcttcaaacgtgaccgctttgatcccgcgatattctggaatcccaactcctgcttcgtcaatatctccaactgtcgataaattgtcggtagagaatgcgtctgggccaatgccagttactgtttcaccttgcagtgttgctggaactaccaaatgaccaccttgaagcaattgacgggccaaatcctcattttcgacatctgtaatgatcccgtcctctatggaaacatcatcgtcagttaaagtaattgtctgattttgttgcatcggtaccttttcaatcttaggtcctgcagagtcaatcgtatctgctttgaccgcaataccgctgattccgaataggagtgttgttaaaaagctgatataaataagtctgctcgtcttcatattggggacctcctcatcaatcctgtcatctctttacacctgtattttaacacgtatgattataattactataaatattgtcttatagttaatgccattataatcattaaatcagctaaattcattcatttttggcaataaaaatgggccatttgtctagtcccggcaaatggtcccagtatgctaactattgaattgtttctgtgattgcttccttcatggcttgtgtactcaactcctgcccaattcccggtcgatcaggaattgtgaaccagccattcttaggctcgacgtgatatttaccggaatcgatattgggctgcttcaaggaaatctcatggtactcatgaatcagagtgttgggcaatactgcctccagctgtaatgcggcagccgttgcaatcggactaccacacacgtgaaattgaatactgacatcgtcaattgccgccagatcgctgatctttttagcttcggtaatcccaccacagatgccaacgtcgggctgaatcacactcagtgatcgttcatcaagaaatggcttgaacccatatcgagttactaatcgctcaccacttgctaagggaatagaaacattatttcggatttctttggttagctggggattcatcggtgagttgggctcttccatatagtaaatgctcaggggctcaaccttagcggcaaacttaatggctgaatcgacgttcaatcgagcgtggcattccaaaattatatcaacattctctcccacggcttggcgaacagccgcaatccgatcataatacatttgaatttgtgcctgggttagcagttgctggtcatgcacaccaaatgttccatctgcctgcatcataaatggatcaactttgagggccgtataaccttcttgaacagctttttctgctgcttgagcataatcctttggtgtcgccaggaattcaacatgcttgccccagccgaactgaatttgactggcgtaagctcgaattcggttttgggtttgaccacccagcagctgatacacaggggcatgaaagtatttgcctttaatatcccaaagagcggtatcaatggcactcacagctgaataaaagacaaccccaccgccttttccccaaaacgtatcttgatagagttcattccagatggcttcattccgcaatggatcttggccgatcactcgatgggccaaatctttcagactgccgacagctcccaaaccgccactgccatatgccagtccagcttcaccaaatcctgagatgccggcatccgtattaattcgaatcacaactggatgccaagctggcatgagtccaaaccactgcaattgaaagatatcaacgctgataattttcataaagcaccccttttcagcctttaaaactgatcatcatgtgagcgatccaacatgatctcggccaatcgtttcggtggaagcggcccgatgctggtcgtcaaatcagcccttgcaaaggcatccgtgagggctgataaattgaattcagtcccatccaaccgctcggtaatggcatgaagatttgaatttggttgtaagaaatccccataaatttgcgaatcaaccacgtggttgtcttgaatcgagaacccgattccgaccgttccaataccgttaaaataaccatctctgtaatattgatgttgattgccagcgccaaaaatccaggtcttgctgccatatttagtatgagccaacgaaacaattgcctgccaatctttctcagtcaatcgataggttggaacttgcgccagattagttgtttgaaacacttgggtcaaaattgtttgttgaacttgatcgattgaaactgttcgatgggcagcatcaaagtgctcgcggagatttgtcacccgactgtgaaccgattgaacgcctttagccctcaactttgcccgtgatggtttcaacactgagctggcagcctcgatatcgacatcaatcatcagcgtgccgccataggacacccgatgaccaattttggaagctgacatcccggaaaacttgcggccatcaactgttaaatcatttcgactgtcactctccgcattgacgcccagggactgcaacgctttaacgactggttgggcgtattttctgaaatggggatgttggacagttggctcagtatcaataaaaacgtacgtcagatttccgggatcaacgtagacggctccaccaccagaacctcggcgaaccaaatcaatcccgtgggcctggagataagccatgttcacctcggcaaaaacgttctgatgaacgccacaaatgacaattggcgtttgcgggtggtagaaatacaccagtgcatctgaaaacttcgccgttgtctgcaggtattccggaaaggcctgttcaaccgttgggtccttcaaatatttcaatccattggatgtatctagataatgaataatgatcccttctttgagactacttcttaatatacatatatttataattccattgtgaccccgttgtattgtgggtaatgccgtgcaaataaggtcgtttcagatataagttgtaattctggaataaaggtgtggccccttgatcctgcatgataatcttctcagctgccaacatcttgttccaacgaatcgatgggttggcgttgttggtataaattgactggctgatcagctgatcaaattttgcattatgccatgagccatagttcattgaattcttgctcatcatcggctgcagaaaggcggttggatcagcaatgtcagctccgcgaccggtaatgtacgcttcaaaatcgccggaaactccgcgggcatactgaacttcttgaggaaccgtctgaagattaatcgttaatccaggaagttgtttctcagcggatgatttgataaattcactcactttcttcacgttatctgaattggcaaccatgaggttaaaggccagcttcttttgaccaatttgttttaatcctttgttccaataatccttggccaacttaggattataggcaaccccttcaccgccatattgttgagaagcaaagtccttattgttggccggatcataagccaaatatttggtaacaaatccagttggcttcagtgattcgcctttcaagaggttgttggcaatctggctgcgatcaatcgttaatgaaacggctttgcggatatccacattattaaaagctttccgcaaggttggattcttgatcttttggttataaaccaaatagttcatgtatgagtacggaccgtggtataggtcggcactattcttataatgcgtgacctgatcgccaattaaaattgtaaaatcaagtttgtgtgcctgatataacgacaaactggtctgtggatcagtcacataattcatatgaattgtgttcatcttgacatgctttttgtcccagtagtttggattctttttaaatgtccaagtattggattgtggggcccattttttgatgacatatggcccggaaaaaacggccttattggcagcttggccatagctggcgccgtatttgtcaacgatctttttgtcttgtggtgaaaaggcctgataggtcatcaatttagtgaagtaggcaatcggccgatccaaatgaacaacaaacgttcgcttattcggtgccgcaacgcccagcgcgcttagcggcagtttcccaaagttgaccttttcggcattcttcacgccatcaaacagataggcatgggtggacttggtcttgggattcaacgtccgttgccacgaatagacaaagctgtcagctgtaattggatccccattactaaacttggcgttctttcgaattgtgaaagtataagtcttaccggcattggacacacgatactgacttgccaacgccggaaccggcttatgattcctattcatgtacaacaaactatcatagagattaccggcgttatcgaagccctgggcttttgaaatatccagggtcacgattgaatagttcgccgacaagttggccgttcgaaccaacttgctgttgtcttttgacttagtctggctcgaacaagccgctagtgtccccacactcaaaacacctgctgctaaaaggagcaaatttctcaaataatggatcatattcttaacaccattcccttcaaataatcctgttaccgcttacaagaggtccccaaaataagttcaaaggacaggtgaccaaggggagaaggtcgctggctttgaacttttaacacgtgaatatcttacaacaggtttaccacataaatcaaggacaaattttggtacaaaaataccacacaaagaattatttgtgtggtatcatatttttatctcattttacgattcttctcgaatcactggtttttcctttaagctcaattgctccacgttcaagactttatcaaccaatccatcatagaagctggactcatggctgacaataattaagttaccggggaaccggtccaaagctcgcttcaaggcctctttagtctcttcatccaaatgattggtgggctcatccataatcaggaagttggtcggggtgaactccatcatggccaatttgaccttggtttgttcacctccggaaagttccccaattggtttaatggcattggcagcatccagaccgcatttggcaagcttggtccggattgcccgttggtttaatttaggaaatttatccgaaataatctgcatcggcgtcatccggttgttatcccattccagttcctggctgaaataactgatgtgagatgatggcgagaatttggccgttccacctttggcaggcagttgaccgaggattgatttgatcaaagttgacttaccaaccccgttaaaccctgcaaagccaaacttctctcccattgaaatggtgaaggtaaccggcttaagtaatggcttattgtaaccaaccgacaaatgatcgacggtcaaggcttcatgagaaccggtttcttcatagggaaaattgaagctggccttgatattagtcgaaggcggatcaattttatccatatgggccagtttcttctcccgcgatttggccatcgtggacttggaacccgccttgttcttacggataaagcgctcagctttctcgatttcgacctgctgcttatcgtactcacgctgttggaattcttctctctcagcccgttgacgcatcgcttgtttgaaactaccacgatatttggtaatcttcccaaaagcaacgttgatgatacagttagtgattttttccaagaaatcataatcatgtgagacgaccagtgcagaaccggtaaacccattcaaatagtcgatcaaccagtcgatttgagcggtgtccagatagttggttggctcatcgagtaaaatgacgtcgggatctgccaacaacattttggcaaggatgatcttggaacgctgaccacctgacatctggccaaccaggtgatcgcgaccaatgttatctaatcccaagccggtaatcgtctgttcaattctggtgtcaatgttatagaaatcgctggaatccaagatgtcctgaagtttcccagcccgctccaacaatttatcatcggccgtcttagcataggtattataaagttcattcaattggtcactagttttgtataaatcagcaaatgccgtgcgcaaaaagtcgatcagggttaaatcttcctcaacatcggcatactggtccaaataaccaattttaatgtttttctgccactttatgtccccagaaagaggcagttcacttccggtaatgatcttgatgagcgttgatttaccaaccccattttgacccaccacgcccatgtgctcgcctttttcaagcgtaaattcagcatctttgtacagatccttctcagcaaagctcattgaaagatttgatacggatagtaatggcaaaaaagttcactccttaattaattcgaaatactacatacaatttgttacgttactcttgtttcctatagtagtcaaactaatcgtgcgaagatttcgctttggtatataatggaaacattacttttaaaggatgatcataaatgaatatcagagaaattgaatacattacaatccccgtctccaacctggaagtcagcctcagattttaccacgaggtctttgacctgcaaattgttgatttacccaacggtgataagggagcggacatgcacaaaatgttccttgacttccacgaggaagacaaggtcgacaacccaatctcatttggcttgattgctaaagacaaaatggccgatatcaaagcccatttgattaactactttgtggatatcgtgagtgaaccgaccgaaaaaactgaagtaaggagaaacgttaattcgatcacgattttagatcctgacaagaatcggatcgaagttaacgagttcagataaatgaatccaaccaggtatctcatcactaaatcaacgcaaattttaaaattcgtggggtttctggcaacttatattgtagcggaatcagtttttgaaattgccggtcaatacatcaaagaccctctgagtgctcgtcaccttctgggactggcactggttttgattgccggggccctggctttgatcggttggcgttatggtaagcagctcgctgctaacaatccacggcattttggccgacggcatccgactgccaagcggatcgcccaactgttatggatttttattttgatgacggctatccagatactttggcagtggctcattgccaaccacgtcttgactacacccagcaatcaacaggctgtcgaagccgccgaagtcaagatgcccatgtggaacatcttttttggcgggattctcgcaccgatttttgaggagcttatttttcgtggcatcttcatgaattatttcttcaataaagataaccggctgaacaatcttttggcagtcatcgtcagcggctcgctgtttgggtttgcccatgagatgagctttgacctgacttggatcatgtattccgccctcggctgctgcttatcgtttgcctacatgcatttccgtgatattcgttatagtatcgcacttcatatgatgaacaatttgattccataggatgagaatatgaaccgcactatttagtcataaaaccaaatcacaattaaaacagagatcgggacacagctcacaatgagtcaatttgaaaaaggatttcaacctgcaatgggttggaatccttttttattttctatgaaattaacggtaataagattgattggaattggtgggttaaatagaatccaatggtgatgaatggcacaaatggaattttggaatttttcggccacggcgcaacaattaaataaagcagtgcagcgacgcaagcaataaacgtttgccaaagtaagcttggaatatccagtgccagccacaggcaaaaataaatgtcgatgtcgccactgcccatccaggaaaagtggtggtttaaaaattggatgagcagatagatcagaatggcaatcaaaatttcttggactggatgggtgtttgataatccgcagacaagcaacagcatgataattccgtctgttggaattgtttggtcgacaatgtcaaaggaactgagtgcgattaaaataatcaacatgccaacgtacagacaatttatctcaaaaagattcaaacccgcagcaacagatccggccgccaactcaacagtgaacaaatttgctgaaaacttttgtttgcagtaacgacattttcccattaaaatgatgtaactgaagacaggaattaaatcaaaattcttcagctgaccaccacaacaatcacaatgggagcggggagcgacaatcgattccccgcgttgtcgtctgacagcaaccaaattaaaaaacgacgccaggcttgcacccagcaaaaattgaataatcatcatcatagtttttacctctgtactttatgtacgttgttacgttttaaattattcaacatgattcattgacacaaacggccagtcatgataaattagacaaggtgctttttgtgacagattcctgaatattcagacatgctgactgtatatgacaaaaagtgttgggcggtacacatttctttttacataaaaaagaaccgcctggatgtgtggacttacattgaaaatttgaaaggagaactttttagatgcctacaattaaccaattggtccgtaaaggacgtcattctagaacttcaaaatcaaagtcaccagctttaaactatgcttacaatagtttcaagaagaagcaagttactgttccagcccctcaaaaacgaggtgttgcaactcgtgttggtactatgacaccaaagaaacctaactcagctttacgtaagtatgcccgtgttcgtttgtctaacttaattgaagttacggcttacattccaggtattggtcataacttacaagagcatagtgttgttttgatccgtggtggccgtgttaaggatttacctggtgttcgttatcacgttattcgtggtgcacttgataccgctggtgttcaagaccgtcgtcaaggtcgttcaaaatacggtacaaagaagcctaaagaataatcttactaatgcaatctaaatatttagttttatagaatcatgaggaggataacgaaatgcctagaaaaggaaatgttcaaaagcgggaagtacttcctgacccaatttataactcaaaattggtaacccgtttaattaaccgtttgatgttagacggtaaacgtggaactgcatcacaaattttatatggtgcatttgatttaattaagaaagaaactaacaacgaaccagttgacgtctttgaagaagctatgaagaacgttatgccggtccttgaagttaaggctcgtcgtgttggtggttctaactaccaagttccaatcgaagtccgaccagatcgtcgaacaactttgggattgcgttggatcgttaactatgcccgttcacgtggtgagcatacgatgactgaacgccttgcgcgtgagatcatggatgccgctaataataccggtgcatcagttaagaagcgtgaagatacacatagaatggctgaagccaaccgtgcctttgcacattatcgttggtaatctcaggatttttctaaacagctcaaactaataagtggctgatttagccactttttgtacgaatcggaaggagttacacaatggctaacaaacgagagtttccgctcgaaaaaactcgtaatatcggaattatggcccatatcgatgctggtaaaacaaccacgaccgaacggatcttgtactatactggtaagattcataaaattggtgaaacccatgatggtgcttcacaaatggactggatgccacaggaacaggaacgtgggattaccatcacgtcagctgccacaactgctcaatggaaagaccaccgtatcaacattattgataccccaggacacgtggactttactgttgaagttgagcgttcattgcgtgtcttagatggtgctatcgctgttttggatgcccaagcgggtgttgagcctcaaactgaaactgtttggcgtcaagcatctgattatgacgttccccggatcgtctttgttaacaagatggataaagttggtgctaactttgatttctcagttggctcaattgaagaccgtttgaatgctaagccacttccaatccagatgccaatcggtgctgaagatgatttcgaaggggttattgacctgatcgaaatgaaggccgacatctacgatgaagataagcttggttcaaattgggatacagttgatgttcctgatgaatataaggatgaagctaaaaagcgtcgtgaccaattagttgaaactttggctgatgttgatgacgacattatgaacaagtaccttgagggtgaagaaattccaattcctgaaatcaaggctgctattcgtaaagctaccttgaacttggaactgttcccagtattagctggatcagccttcaagaacaagggtgttcaaatgttgatggatgctgttattgactacttaccatcaccacttgatgttaagccatacaatgcaactgatcctgcaacgggtgacaagattgaactgaaagctaatgatgacgccagttttgctgctttggccttcaaagttgctactgacccattcgttggtcgtttgacttatatccgtgtttactcaggtacccttgagtcaggttcatatattttgaatgcaactaaagacaaacgtgagcgtgttggtcgtttgctccaaatgcattcaaatcaccgtcaagaaattccagaagtattctcaggtgatattgctgccgccattggtttgaagaacaccactactggtgattcactgactgatgttgaccatccacttcatttggaatcaatggaattccctgacccagttattcaggttgccgttgaacctaagactaaggctgaccaagataagatgaacgttgctcttcaaaagctttctgaagaagatccaacattcaaagcaacaaccaaccctgaaaccggtgaaactttaattgccggaatgggtgagttgcatttggatatcatcattgatcgtatgaaacgtgagttccatgtggaagccactgttggtgccccacaagtttcataccgtgaagcatttaccaagccaaccaaggctcaaggtaagtttatccgtcagtctggtggtaaaggtcaatatggtgatgtttggatcgaatttacaccaaacgaagaaggaaaaggcttcgaattcgaagatgccatcgttggtggtgttgttcctcgtgaatacatcccagccgtagaacaaggtttgaaagaatcattggctaacggtgttcttgccggttacccattaattgatttgaaagccaagttatatgatggtagttatcatgaagtcgattctagtgaagctgcatttaaggtagctgcttcaatcgctcttcgtaatgctgccaagaccgctgctccagtaatcttggaaccaatcatgaaggttgatatcaacgtccctgaagagtacatgggtgatgttatgggccaagttactgcacgtcgtggacgggttgatggaatggaaagccgaagcggtgccgaagttattcattcattcgttccacttgctgaaatgttcggttatgcaacgacacttcgttctgcatcacaaggccgtggtactttcaccatgacatttgatcattacgagccagttccaaagagcatccaagctgaaattattaagaaaaacggtgggaaccaacctgctgaagattaatttcaaacgtagagatcggaatttaattccggtctctttttttgactaaaggtctgtcaaatcatcccgcggcaatgtataataaattggttgaagttatttacgttcatttgaatatcaaaagaagttaaaatcatttttcaagtaacagtaatgttacaaaacgaattaattgctgttaacacttgttttatgcggctttttttagtacactatttgagtacttgtttttagggataagtttgccctaaagcaatatgtattagctttgatgtgaaaggttgcgacacacccggatgctttgccatgggtttggcggtaattttcacggagttagtcctattttcaaaatagacgaaggagggaacacaatggcaaaacaaaaaattcgtattcgattgaaggcatacgagcatcgtatccttgatcaatccgcagacaagattgttgcaactgcgcaaagaactggagctactatctcaggtccaattccattgcctactgatcgtacaatctacactgttttagcttcaccacataagtttaaggattctcgtgagcaattcgaaattttgactcacaagcgattaatcgatattttaaatccaacgccaaagacagttgactcattaatgaagctcgacttgcctagcggtgtggatattgaaatcaaactataataaatacaatatatcggaggtgtactcatggccagaaaaggaatcttaggaaagaaagttggaatgacgcaagtcttcactgaaaacggcgaattagttccagtaactgtcgttgaagtgacacctaatgtcattatgcaaatcaagaccgttgaaaatgacggttacgattcagttcaattaggttatgcagacaaacgtactgtgcttactaataagccagaacaaggtcatgcaaagaaagcaaatacgactcctaagcgcttcattaaagaaatcaaagatgttgagctgggagactataaagtatctgatgaagttaaagcagatatctttaaaccaggagacatcgttgatgtaactggaaccacaaaaggtcatggataccaaggtaacatccataaagacggccaatcacgtggaccagaaactcatggttcccgttatcaccgtcgtccaggttcactcggtgtcattattaaccgtgttgttcctggcatgaaattgcctggacgaatgggtaacaagactgttaccattcaaaatttggagatcgtaaatgccgatactgacaacaatgttctcttaattaagggtaatgtacctggtgcaaataaatcatatatcacaattagaagtgccgttcacggctcaaacaagtagaagggaggcaaccatagatgactgacgtagcattatataaacaagacggaagcaagaatggtaccgttgcattaaacgatggtatcttcggcatcgaacctaacaacaatgttgtgtttgacgcaattgttatgcaacgtgcttctttacgtcaaggaactcattccgttaagaaccgttccgcagttcgcggcggtggaaagaagccttggcgtcaaaagggtactggtagagctcgacaaggttctattcgttcaccacaatggcgtggcggtggaattgttttcggacctactccacgttcatactcataccgtttgcctaagaaggtttcacgtttagcattgaagtcagtgttatcagaaaaggtttccgacaacaaattggttgttgttgatactttacaatttgatgcacctaagactaaagaattcgctgaattgttaggtaaattagacgtttcaactaagacattagtagttttggaagacgacaacgaaaaggcagttctgtctgctcgtaatttggaaaacgttaaagttgtttctgctcaaggcattaacactttggatgttgccgatcacgacaaagttgttattacgaaagctgctctttctcaagtagaggaggtgctcgcataatggaatcacgcgatattattttacgcccagttattactgaggaaacaaccagtaagatggacgacaagacatacacattcgatgttgatttacgagcaactaagacccaagttaaaaaggccatcgaagacattttcgatgttaaagttgtccgtgtaaacatcatgaacgttcgtggcaagctcaagcgccaaggccgttacgctggttacactaagaagcgtcgtaaggcaatcgttacattgactgaagattcaaaagaaatcgaattattcaacgaagaataatcaaacaaatctctaatataggaggaacacgttttggccattaaaacatataagccaaccagcaatggtagacgtaatatgacaagcttggactacagcgcaattactaagcgtaagcctgaaaagtctttacttgaatcaaaaagtaaaacagccggccgtaataattacggtcatatgactgttcgtcaccgtggtggtggtaacaagaatcaatatcgtattattgacttcaagcgaattaaagatgatgtcacagccacagttaaagcaattgaatacgatcctaaccggactgctaatattgctttgattgtttatactgacggaatcaaatcatacattattgcacctaagggattaaaggtgggcgacaaggttgaatctggcgttgatgctgatatcaagcctggtaacacattgccattatccaacattcctgttggtacaattattcacaacattgaacttaagcctggtaagggtggtcagcttgttcgttcagctggtgcatctgctcaattgcttggtcgagatggcaagtattcacttgttagacttgcatctggcgaagttcgtttaatccttagcactaaccgagcaactattggttcggtaagtaatgaagaacatgaacttatcaatgttggtaaagctggtcgtacacgttacaagggtcaacgtcctcatgttcgtggatctgtaatgaaccctaacgatcaccctcatggtggtggtgaaggtaaagcaccagttggtcttccatcaccattatcaccatggggtaagaagacagttggtaagaagactcgttctaagaaagcacgttcggacaagtttattgttcgtcgtcgtaaaggttcaaagatgtaatagaacgcatttattaataacaattaatatctgtgcagaggaggttgcaaaatgagtcgtagtttgaaaaagggaccattcgccgatgagtacttactcaagaaggtagatgcccaaaaagaccaagataaaaaggccgttatcaaaacttggtcacgccgatcaacgattttccctagcttcattggatatacatttgctgtttatgatggtcgtaaacacgtcccagtatatgttcaagaagacatggttggtcataagctcggagaattcgtacccactcgtacattccatggtcatggaactaacgataagaagactgtttaataacaaggaggataacaaatggctgaacaagttacatcagcaaaagcaactgccaaaactgttcgcattgccgcacgtaaggtccgtcttgtagttgatcttatcaaaggtaagagtgttgctgaagcagccgcaatcttggatttcacaccccgcggtgcttctccggtagtttcaaaagttcttaaatctgcagttgctaatgcagaaaataattttgatttagatagtgaaaacttgtttgtaagtgaagcatttgttaacgaaggcccaacgcttaagcgattccgtcctcgtgcaaaaggttcagcttcaccaatcaacaagcggacaagtcacattacaattgttgtatcagaaaaagaggagggataacgcgtgggtaataagataaatcctaatggtttacgagttggaatcattcgcgactgggaagctaagtggtatgcaggtaaagactatgcagcttacttaaaagaagatttacaaattcgtaaatatatagagaagcgtcttgctaatgcgtctgtttctactgttgaaattgaacgtgcagcaaaccgcgttaatgtttcaattcataccgccaaaccaggaatggtcattggtaagggtggatctgaggttgaaaatcttcgtaaagaacttaatgacctcactggtaagagagttcacatcaacatcatcgaaatcaagaagcctgatttggatgccaagttggttggtgaaaacatcgcacgtcaacttgaaggccgtgttgctttccgtcgtgctatgcgtcaagcaatgcaacggacaatgcgttccggtgccaaaggaattaagacccaggttgctggtcgtctgaacggtgctgatatggctcgtgttgaatcatactcagatggaactgttcctttgcatactttaagagcagatattgactactcatgggttgaagcttttactacctatggatcaattggtgtaaaaacttggatctatcgtggtgaagttctccctgaaaagccaaaggacagcaacgctgctaaaggagggaaataaacatgttagtacctaaacgtgtaaagcatcgtcgtgaacatcgtggcaagctccgtggaactgccaagggtggcaagacggttactttcggtgaatacggtttacaagcacttgattctcattggatcactaaccgtcaaatcgaagcatgccgtgtggcgatgactcgtcacatgaagcgtggaggaaaagtttggatcaagattttccctcataaatcatatactgaaaaaggtgtcggagttcgaatgggtaatggtaaaggtacaccagctggctgggtttcaccagttaagcgtggcaaagtattgttcgaaattggtggagttgacaaagcaactgcccatgaagcattacgacttgcatcaaacaaacttcctgttcgcactaagatcatagaacgtgaggaagtaggtggcgaatcaaatgaaggctaaagatatcagcaagttaaccactgctcaaatgattgataaagaaaaagattacaaagatgaactgttcaatcttcgtttccaattagccactggccagttggagaatactgcacgcttgaagcaggttcgtaagaacattgcgcgcattaagactgcacttcgtcaacaagaactcaacaaatagaatacgataagggaggtataattaatggctgaagaacgtaaccagcgtaaggtttatcaaggacgcgttgtttctgacaagagtgataagacaattactgttgaagtttcaacttacaagaaacatgcaacatatggtaagcgtgttagatactcaaagaaatttacggctcatgatgaaaataacgaagctaaaaccggtgatcttgttcaaattatggaaacacgtccattgtcaaagacaaaacgtttccgtttaatcaagattgttgaaaaagcagttattatttaactttacttaattatcattattatcgtattcgatccaatgatgaagggaggatatacctgtgattcaacaagaaagtcgtttaaaagttgccgacaactcaggtgcaagagaattgttaactattaaggttttaggtggctcaaccagaaggtatgccggaatcggcgatactattgttgctacggttaaacaagcaacaccaggtggcgttgtcaaaaagggtgacgttgttaaagctgttgtagtccgtactaaggctgttactcgtcgtaatgatggttcatacattcgttttgatgaaaatgctgcggttcttatccgtgatgacaagagtccccaaggcactcgtatctttggcccagttgctcgcgaattacgtgacagcaacttcatgaagattgtttcattagccccagaagtactgtaatcacaaccaggatataaggaggtgccgtagatgttcattaaaactggtgacaaagtccgtgttattagtggtaaggacaaaggtaaggaagggacagttactaaaactatcgcttcaaaagatcgtgtgattgttgaaggaatcaacaaagttaagaagcatacaaaagcttctcagacgaatccacaaggtggaattgttgatgctgaagccccaattcacgtatcaaatgttatgctaattgacccatcaaccaacgagccaactcgtattggtattaaagttgaagatggtaaaaaagtacgttactcaaagaaatcgcaaaaagcgatcgattaatcactagcgaaaggaggataccttttaaatgtcaagtcgtttacgagaaaaattcaatagcgaaattacaccacatatgatggataaatttagctacaaatcagttatgcaagctcctaagatcgataaaatcgttcttaacatgggtgttggagacgctgttactaacgccaagaacctcgatgaagccgtttctgaattagcattgatttcaggccaaaagccactggttacaaaagctaagaaatcaattgccggatttagattacgtgaaggaatgtcaatcggtgctaaagttacactccgtggagatagaatgtatgacttcttagataagttagtcaacgtttcgttaccacgtgttcgtgatttccatggtgtcagcactcgtgcctttgatggtcgcggtaactacactttgggtgtccgtgaacagttgattttccctgaaatcaattacgataatgttaaccgtgttagaggtttggatattgtaattgtaactactgcaaataccgacgaagagtcacatgaattgttagttcaattcggtatgccgtttgccagataaagaggaggtttcacattggctaaaaaatcattaattgtaaaaagtgaacgccctgctaagttctcaactcagaattacacacgttgtgaacgttgcggacgacctcgttctgtatacaagaaattccatttatgccgtttgtgcgtccgtgaacttgcccacaaaggtcaaattcctggcatgaagaaagctagttggtaataattaaaaaggaggttgtgcgctgatgtctatgactgatccaattgcagactttttaactcgcattcgtaatgcaaacatggtttaccatgaaacagttgaagttcctgcatcaaaaatcaaacgtgacatcgctgaaatccttaaacgtgagggttttgtacgcgatgttgaatatatcgaagatgacaaacaaggcattatccgtgttttcttaaagtatggcaaggataagcaacgtgtcatcactggtcttaagagaatttctaagccaggtttacgttcgtatgttaaagcagatgctgttcccaaggttttaaatggtcttggaattgctatcatttccacatcaaatggtgtgatcacagataagcaagcacgcgcccaaaaaattggcggcgaagtgttagcttacgtctggtaaaattcatcaaatcggaggtgtaattaatgagtcgaattggttataaaaccatcgaattaccaaaaggtgtcgaggtaaaagcagatgggaatactgtaactgtcaaaggtgccaaaggatctttaacccgcgagatttcatcacaaatcaagatgactatcaaagataacgaagttaactttgagcccattggtgattacaacgacaaagtacgtgcattgcatggtacaactcgtgccaacgtcagcaacatggttgatggcgtaactactggcttcaaaaagactttgaagttggttggtgttggttatcgtgcacaacttaagggcaagaacctgacattaaacgttggttattcaaacccagttgaaatgactgttccagatgatctaactgttgaagttcctgataacacaacgattcacatcaatggtatcagcaaacaagcagttggtgactttgctgcatcagttcgttcagtacgttcaccagaaccatataagggtaaaggtattcgttatgagaatgaacatattattcgtaaggaaggtaagactggtaagtagtaagatgccagcctaataaaattttgaggtgactattttgatttctaaaccagataagaataagaatcggaaacgccgtcataatcgtgtccgtaataaaatttctggtactgccgagcgcccacgcttgaatgtttatcgttctaataaaaacatctacgctcaagtaattgatgacgtagagggtgtaacgcttgttagtgcctcaacacttgattctgcaatcagtagtggtaacaagactgaacaagcagctagtgttggtaaattagtagctcaacgcgctagcgaaaagaacattaaagatgttgttttcgatcgtggtggatacttgtatcatggtcgtgttcaagctcttgcagatgctgctcgtgaaaatggactagaattctaaaaaggaggaataaccgcacatgaagaaatttattgatccagataagttagagcttgaagacaacgtagtttcgattaaccggatcactaaagttgtaaaaggtggacgtcgtcttcgttttgctgctttagttgttgttggagacaagcacggtcatgttggttttggaactggtaaagctcaagaagttccagaagcaatccgtaaagccgttgaagctgctcgtaaaaacttaattgaggttccgattgttggtacaacgattcctcatgaagttctcggaacatttggtggcggccgaattttattgaagcctgctgaagaaggttctggagtagcagctggtggtgccgttcgttccgtgatggaattagctggtattgacgatgttactagtaaacgactaggttccaatactcctatcaacgttatccgggcaacattcaagggcttggttgagttgaagagtgctgaagaaatttcagctttacgtggggtttcaacccaacatttagctgaataaggagggtgttttagatggctcaattaaaaattactttaaaacgtagcgtaactcatcgccttccaaagcaacgtaaaattgtgaaggcacttggcttgggtcgagttaatagtaccgttgttaaaccagacaacgaatctattcgtggagcccttttccaaattgctcacttaatcgaagttgaacaagttaaagactaaaaattagtaaggaggtgccaatttcatgaaattaaatgaattgaaggctgctgaaggttctcgttcattacgtactcgtaaaggtcgtggccgttctgccggtaaaggtaagactgctggtcgtggccaaaaaggtcaaaaagctcgtagcaagactcgtgtaggtttcgaaggtggccaaatgccattgtatcgtcgaattcctaaacgcggattcaacaacatcaaccgcaaggaatatgctgttgtaaatgttgttaagcttgaaagctttgacaacggtacggaagttacgcctgaattacttcaacaatcaggactcgttaagaatgccaaatcaggcatcaagattcttggtgaaggtgaacttactaaaaagttgaccgtcaaggctagcaagttttcaaaggctgcacaatccgtaattgaaaatgcgggcggtaaaatcgaggtggtttaatgctttcgactttagcaaaagcattcaaagtgaaggatattcgcaataaaatgctttttactttgtttgtgctagttatattccgtctgggagcatacataactgttcccgggatcaatgccaaagcattaacatccgttgcatcttctggtttggttagtatcctgaacacctttagtggtggtgggttgactaattattccatctttgcgatgggggtctcaccttatatcactgcacaaattatcatccagttgctccagatggacattgttccaaaatatgttgaatggggtaagcaaggtgaagttggtcgtcgtaaattaaatcaacatacgagatacttaaccgtcatcctagcctttttccaatccgttggaattaccgcaggatttaatcaattaagtagtctgaatcttgttcaaaatccaagtatcaaaacatttgtgatcatcggcttgattttaaccggtggaacaatgttaacaacttggatgggggacatgattactgagcgtggcttaggaaatgggatttcaatgattatctttgctggtatcattgcccgaattccagtcggacttcagtcattgtggacccagtattttgttggcgtttctggcgctgatctatggcaaccaatcctttttgcgattgcattgctgataatcgtgttagtgatcgtaacctttgttacttgggttcaacaagctgaacgaagagtaccaattcaatatacaaggcgagtttctggatccccagacagcagttaccttccattgaaggttaacgttgctggtgttattccagttatctttgcaagttcatttattgcaacgccgcaaactatcttgatggcattcactaacaattactcaactgcaacttggttccaggtattgaataatctattcaatatgcaaacgccgaccggtgcagctttctatacaattctcattatcatgttcactttcttctatgcctttgttcaagttaacccggaaaagctttcggagaatttgcaaaagcaaggcagttacattcctggtgtttggccagggcatgagacccaatcttatgtgtctgatctgttgatgaagctaagtactgtcggtgcgttattccttggagtggttgctttgattcctttgattgcgcaaaacctgtggaacttagatgaatcaattgggttaggtggaactagcctgttaattgttgttggtgttgctattgaaacaattcgtcagattcgtggtttaatgatgaagcgagagtacgttggcttcattcatgatactcgaccaactgatgactaaatttgagcaattccgctattaattaggaggacaataaaatgtcattgaacttgatattaatgggattacctggtgcggggaaaggtactcaagcccaatttattgtggacaagtatcacgtacctcacatttcaacaggagacatgttccgagatgcaatctcgaatagtacaccacttggggttaaggccaaatcctttactgataaaggggatttagttcctgatgaagtgactaatgggattgtaaaggaaagattagcccaagatgatactaaaccaggcttcttattagatggttatcccagaactttggaacaagcagatgtgttgtcgcaaatgaccaaagacttggataaacctttgacagccgttatcaacattgatgttgatcctaagttgttgactgagcgtttgtcaggtcgcttcatctgtaaaaactgtggtgccacttatcataagttgtaccatatgcctaaagttcccggtacctgcgatgtctgtggtgggcatgaattttatcagcgtgaggatgacaaaccagaggctgttaaaaatcgtcttaaggttaacgttaagatgaatacaccattgatcgcatactataaggatcgaaatcttttattcaatgtcgatggcagcaaagacattgatgaagtttggcaaaatgttgacaaaatcttgagcacactctaaacctcactaattaagtgttgagtcggttagattgatgaaatataatgaatgtgttaaactgtcaaaggtttgtcaagattaatttaatttattcaatctaatttaacattggaggtgtattgagtggctaaagataatgttattgaagttgaaggaaaagtcgtagaaacattgccgaatgcaatgtttagagttgaactggagaatggacacgaaattctagctcatgtttctggaaagatccgaatgcattacattcggattcttcctggagataaggttaccgttgaaatgtctccttacgacttaaccaagggacgtattacttatcgatttaagtagtcctttttcgtcattttttttcgaggagggttaaaaatgaaagtacgaccatcagtacgaaaaatgtgtgaacattgcaagattattaaacgaaaaggccgagtaatggttatttgctcagcaaacccaaagcacaaacaacgccaaggtaaataaacataaacaggaggtgtatgctcaatggctcgtattgccggaattgatttaccccgtgacaagcgaattgttatcggattaacttacatttttggtattggtaacacaacagctcaaaaagtcttagcaaaagttggagtttctgaagatgttcgtgtacgtgatttgacaccagaccaagaagacaagattcgtgaagttgtcggcgatcttaaaatcgaaggtgacttacgtcgtgaagtaagtatgaacatcaaacgacttcaagaaattggatcatatcgtgggatgcgtcatcgtcgcggattgccagttcgtggtcaacataccaagaacaatgcccgcacacgtaaaggtagcaaagttgctgctggtagaagaaaataattaaagaaggaggtcatcagtttttatggtaaacaaaaagacaagtcgtaaacgccgtgctaaaaagaatattgctgctggtgttgcacatatccattcaacattcaacaatactttagttatgattaccgacaccactgggaatgcggtttcttggtcatcagccggtgcattaggtttccgtggaagtcgtaagtcaacaccatttgctgctcaaatggctgccgaagctgctgctaaggcatcaatggaacatggtatgaaatccgttgaagttgctgtcaaaggaccaggttcaggccgtgaagctgccattcgtgcacttcaagctactggattggaagttactgctattcgtgatgttactccggtacctcacaatggttctcgtcctccaaagcgtcgtcgagtttaattaagacattcaatatagtgaattttacttggtttaagcatattgatattttgcatgaagactcacgcgttttgaaaggggttaatgataagaatgattgaatttgaaaagcctaacattcataaaattgaagaaacaaataattttggtgaagttgtcgttgaaccgctcgagcgtggatatggtacaactctcggaaattctttgagacgtacattactgtcatctcttcctggcgctgctgttaccagcatccagattgatgatgtactgcacgaattttcgacgatcaaaggtgttgtcgaagatgtgactcagattatattgaatgttaagaaaatttctttgaaattagatgggccagaagatgaagaagaaaatttggaaatcgatgtaattggtcctgctgatgttactgccggtgatattcaagctgacagtgatgtgactgttctgaaccctgatttgcacatcgctaccgttgctgaaggtgccacattccatatgcggttaaccgccaacaaaggtcgtggatacgtttctgctgtggaaaacaaaaagcgcagttctgaaatgcctattggtgtgcttcccgtcgattctatttataccccaatcgaacgtgtcaactatcaggttgaaagtacacgggttggtcaacgcgatgattttgataagcttacactggatatttggactgatggttcaattactccgagtgaagcagttagtttggcggccaaaattttaaccgaacatctagagatgtttgttgatttgactgatgaagctaagaataccgaaatcatggtcgagaaggaagaaacccacaaagaaaaaatgttggaaatgacaattgaagaattggacctatcagttcgttcatacaactgtcttaaacgtgccggcattaatactgttcaagaacttacggaaaagaccgaagctgatatgatgaaggttcgtaatcttggtcgcaagtcacttgaagaagttaaagaaaagcttgctgcattgggcctttcacttcgtaaagaagactaataaagataaagaaggaggacatccaattatgggttatcggaaattacaacgtagtagtgcacatcgtcgctcattgcttcgtaatttgactactgagttaattattcatggtcaaatcattactactgaagcaaaagctaaggaagttcgctcaactgctgacaagatgatttcacttggcaagcgcggcgatttacacgcccgtcgtcaagctgcatcatttgttcgtgatgttgttgctgatgttaaagaagatggtgacgatattaacgttacgactgctttgcaaaaagtatttggcgaattagctacaaagtatgctgatcgtaatggtggatatacacgaattttgaagactatgcctcgtcgtggcgacggtgctccaatggtcattttagagttagttgactaactagtattaaaccaaatcacatatttatcacgagaatcactcaggtttttggtatagaacgttatgatggtggaacccagttcctagtctagtttgaatgtgggacttatctcatgcaccgattacctgtaagtgatttttttgtacatagataaaacactttgcacagcgtgaggaacatcatgaaggatattattcaaattaaaaacatttctttcaattaccccgaacaagaaaaactttttaatgatttttcgatgaatattcaggaaggtaaatggacggccatcattggccaaaatggaagtgggaagagtacactggcccgcttaattgacggcttgattgttttgaagtctggtcaaatcgttgttgatggactgacggtcaacgatgcaaatatctttgatattcgaaataagattggcatggtttttcaaaatcccgaagaccagtttgttggagcaaccgtagaggatgacgttgcatttggcttagagaatcgccgagttcctcgtgagcaaatgcatcaaattgttgaacaaagccttcgacaggttggcatgtgggactttcgtgatcggattcctgctaatttatctggcggacaaaagcagcgcgttgcgattgccggaattattgcccttagtccgaaaatcatcattttggacgaagctaccagcatgctggatcctcgcggccgacaaaacattttaaaactggttaatcagattaaacgcgaaaataatctgaccgtcatttccattacgcatgacatagatgaggccgccggtgctgaccaagtcattgttgtcaaccaaggtcaagttgttgaagctgatcagccggatcatatttttggtgatattgaaaaattgacatcgattggcttatccgcaccttttacgtccgaattactgtcagccctcaaaaagcgtggaatcgactcacatagtcaatatctcaatgatgagaggttaattacatggatcaaacaattaatttcaaagaagtaactcatacttatcaagctgatacaccatttgctcaaaatgctttgaatcaggtatccttaaccattgccagcgggtcatttacagcaattatcggtcacaccggtagcggcaagtccactttggtacagcacattaatgcgcttctcaagccgactacgggagaaattgaggtgtcagggcgaacgattacacctgcgaccaccaataagaatttaaagcaacttcgtaagcacgtcggcatggtatttcaatttccggaaaaacaattattcgaagaaacggttatcaaagatattatgtttggccccaaaaattatggggcttctgacgaagaagccagaagcgatgcccaacaggcgatggcattagttggcatcgatgaagatttacaagacaagtcgccatttgatctttccggcggccaaatgagaagagttgcgattgctggggttttggcaatgaagccggaaattctcattctggatgaacccactgctggtttggatcctcgcggccacaaagaaattatggacttggctgaagacctgcacgaacatcagggcatgacgattattctcgtcacgcatcaaatggatgatgttgttgattacgcttctgacgttattgtgatggatcaagggaagattgttaaacatggaagaccgcaagagattttttcggatccccagtgggtatatcagatgcatctggatttgccgagtagtgctgagtttgcttcccgattgatcactgcaggggttccgttaaaaagtgttccactgacaattgacaaattggcggatgcaatcgtagaagctgttcaagggggtcacgtccatgagtaattttctatttggtcggtaccttccaggcaattcttgggttcatcaaatgagtccccaatccaaattgatgctaagcttttattttgtggttgtgattttctttgccaataacatttggacttatgcggcattgagtgtgttgattctcatagtggtcctcatgtcaggcgtgtcgattggttattttctaaaagggattaggccacttatttggttgattatttttactgtcttactgcagattctattcagcagtgggggacatgtctattggcattttggtccattttcagtcagtgataccagcttaattaacggtggttttattttcatccgatttctgttgattatcatgatctcgacggttttgaccttgacaacaacgcccttggcgattgcagacggggtgcagaccgttcttcggcctctcaaaaaagttcactttcctgtggacacattggcgttgatgctttcaattgctttacgttttgtaccgaccttaatggatgaaatggaaactattttaaatgctcaacggtcaagaggggtggactttgggtccggaagcttacgccatcggattcaagcagccgttcccctgctcgtcccattatttaccggagcaatcaatcatgcagaaaacctgtcaactgccatggaagcccgtggctttaccgacagtgagcaccgcagcaaataccggatttatcggtggcagcgaaaagataccattagttgggcagtctttttgttagtcggggtgctcgttttattcataagaaagagttgaggtgttcaatattcgatacaaagtgacgttagcctatgatggcacgttgttcagcggctttgagcgccagcccaagcgcagaacgattgagggtgttttgacccaaaaagtgaatatcatggcaaaaaatcccgacccaccaattgtcgtctacggatctggcaggacagatgccggtgtccatgcccttggacaagttgtccattttgatttcccgttcgatttgccaaccaaggcaatttatcggggactaaacagtctcctgccgcttgacatggagattaaaaaagcggaaaaggtatccaatactttccatgcccgctacgatgtgtccggtaaacggtatgtttatcggctggatttaggcgaatttaaggatccgttcaaacggaattataccggaaattggcgttttcccattgatattgaacgggttcaaacggcaatgaatgatttcgttggtgaacatgacttttccagttttgtcgcttcggggtcgactgcacgatccaatgttcgaacgatttatgaagctaatgcgattttggacaaatcagccaacgaaattcggcttgagttctatggcaatggtttcctctataacatggttcgaatcatggttggggtagttgttgagattgggtctcaaatgcgccctgagcacgatatattgcgcttatacgaggtgaaagatcgtgaccaggcccgacgaaccatgccggcatccggtttgtacttaaagaaagtctattatgagggtgaagatccgaagcatcccacgaaattgccaaaacgacaacgataatttaggaaactaattgactttcatcagaataatttgtattatgttaattggtattgtttgccccacgataagccccggaatcttatttggtgtcgaacaaacacaggaacaatggaggaatatacagtgcgtacaacttatatggcaaaacctggtgaagtagaacgtaaatggtacgttgttgacgcaacagacgtatctcttggacgtttatcatcagcagtagcatcaatcttaagaggtaagaataaaccaacattcacacccaacgtggatactggggataatgtgattgtaattaatgcaagtaaagtcggtctgactggtcacaaagacactcggaagatctattaccatcacagtcgctttattggtggcttgaagcaacgaactgccggtgatttacgtgctaagaatcccgaaaagttaattgaaacttccgttaaaggaatgcttcctcatggaacattaggtcataaaattggtttgaagttacatgtctatgcaggtcctgaacacgatcatcaagctcaaaaaccagaagtattagacattaataacctaatttaaggaggaattcactttggctcaagtacaatatcgcggcactggccgtcgtaaagattcagttgctcgagtacgtttggtacccggaactggaaaaattatcatgaatgacaaagcaatcgaagactatattccatttgctaacttgcgtgaagttgttgtgcaaccattcaacgtaactgagactttaggtaactatgataccttggttaacgttaacggtggtggattctccggccaagccggcgcaactcgtcacggaattgcccgtgcattgcttgcagttgatcccgacttccgtggaccattgaagcgtgccggtttattaactcgtgacgcacgaatgaaagaacgtaagaagccaggtcttaaaaaggcccgtaaagcttcacaattttcaaagcgttaaaatttactttgctttttcaaaacacttctcttttgaggagtgttttttcaccacccgttaacctaatctaaaaaaaattaagtttaaccggttaattatttaattaattaaatctccaacttcacaactgccccaaaaccaaaacaacgatcctagatatatcttatatggcattcgagaacattaattattctgccaaattctcggccatcaagatcctggatcaaccccaaattgcccccggtagaactgattcaacaagtgtgccaaatgttccactgtcgctttaaacgttttattggtcaatagcagatggtcagtaaaatctgccaggtaattctgccaacttaatcgttgcgcctgttgagccgtcaataaggctctgagggctagttcatagctacgggcaattgtggttggtgttgcccaacgggtgattgcatatctgccgcgaccgattgtagtgacggccaactcacctttggtttgtaagtcttttttgagtttgtttagcgattgcgcgctaatgtttagggccgtttctaactgtcgaaaagacatctctaaatagcccccctcgcggtaggcattttgattgatatattgtttcaggtcgttagcccattcacttaagtgactgttctgccggtcaattcgggctttggcatacttatgccaaaccttaggttggggtacttgggccaataaacgggggcttaaataattagcttgaatattttttatgtaaggttgcgtggccccatgataatgaccggaatacgcgtcttttaaaatgcgttcaaattctttgactgccaacggcgcaacattgttagtgttccaaacatctaactcgttataggcatccataaaaggaattttgctgccgaaattggctagggccaaagtcattaagaagttatggcgaccaactcctttacccagaccactttccaccacgttgtttacctgtaaagctgctaagtaccaaggccgtttagcctggggttgccgggcagtccgcaactgagctgcttcgccttgcttaatccgtgaccgaacctgttgtttggcatttgtttgttgacgtttttgggcaacctgttgtttactccattcaatccaatcagcgaaacgactggtggtttgtgggtcataaaacaggatattgttttcgtggggtacgcgaaagaagccaaagttattacagccacaatccaactctgggaatttatggttcatataggcttttaattcgtcagcgattaattgggcaactttaaccactggtaaactgccgtctttttggcggcgaacataggctggttggtccaaaacatagtagacctggtacccgtggggggaatttaggactgcggtaggtttgagttgattattcaacgtcaacaatctttgtttagcttgggtccattcagccttcttctgattgtgataatccaggtccaagacaatgacattaacttgttgcaaattatccaacgtgttgccggcaaaataatgccggtggacatccacatagcgcccatagcgtgatggattaggcgtccagtgggaacaatatggtgcattgtccagaatgccctcttgtgacgttaccaatagaccgcgggcgctggttaaatcgtccttggtacgggtcatggtcacagtgccaacgtgttggggatcgtctttggtatcgacaattttttggtgactattcttgacgcgttgtttggtaactgagttatgtaggatctgttcgatcagggcttgacttttcattatgctttctcctttctatcgttcttatttgcttgcaatcagctgaaagattggtatatcatggcggtataggtttgttaaaagtgaagacctggatatacgatcacaaacgtttagtactagctatttggtatcagaaacttgttaccagatactggttacatgacacttgttggtaaaaacatttgataaaaggcagttgatgcaagacatttaacgtaaaggcattgtttgaaaactcagttggatacttgaattagtacttggttgggcatttagagcatttagttaaacatttagcactcagttaggcttttaacatttggatttagtatcttcttggaccttcacttgactagttattacagaaaataaagatctcctattgaccgccaaatcaaatttcggtaggtctttattttttccaaaatttaccttaaacttttggaacttcaaaggtccaacttttagggcctaaaaaagggggacgcatttttcttgcgtccccttttttacagaatccaccaatttattgaaaccagtagattggaatcctccccgtgagcctgctataattaacttagtgtaaaggtggaccaacacttttaccggttagttaaaaaagtttattacgagaaagatcgttaaaaagttttcgcaagtggtcttgcacttgtgtcgactgagtaagaatcattgcgactgattcttattcaacgatctttttttgttcttttagaaatctgttaatttgttttaacaacccaagattatcatttagcactctttttgtaaatataaaatgtgtaaaagtacactccttcacgatagcgttatgtcaataaatacactaggagaaaaagagattagtgtattagtagaaaaaaggattaggagattagtgtattagtgtattaagagattaggagaaaaatacactaggagaaaaagagattagtgtatctttcataaaggccgatattacaggcttaacaatttctatccttgtttaaaaagtgtactattacacttttctcctaataccctaagagaaaaagagattagtgtattaggagaaaaagggattaggagattagtgtattaggagaaaagggaattaggaacctaataataatttttttgcttgagattaacctgtataaagtgtactattagcatataaatagaataacgttagtgtacttttacaggattgaggcgaatagattgggatatgtaattataaatgcacaacaaaagggcggtgttggtaaaactactgatactgttatggaagccgtcgttgcttcttcattatttaataaaaaagtcctagttattgatactgatcttcagggtaatgctacccagtttcttgcaaaaacctataaggatttaaatatcaacaaatcttttatgagttgtatggaagatggtgacttagaatctggattggttcacctaggcccgaatattgatatgattgcatctgattacgacacacgaaaatttggcgacttcttagctgacaagtttaaaaatacaattgatcgaacgttctatctaaagaagcttgttgataaattaaaagatcggtacgattttgtattcatagacgttccaccttcgacagatattaaagtcgataatgcgatggtttgtgctaattatgtagtcgttatacaagaaacacagcaatttgcctttgatggttcaaaaaagttagttttaacttatctccaaacgctcgcagatgactttggcgataaaattaatttacaagttgctggtatcttaccggtcttacttcaggctcgcagacctttacaaactaaaattgttcgcgaaacaattgagtattttggtaaagacaacgtatttaataatattattaacaaccatgctcgtttggaatggtatactgcccaaggtgtacaatttcaagactttcatgataaacgcatatggggattgtttgctgacattttttgtgaattacaagcacggattgaatcctttgaaaaaaccaacgatgtaatcaattttcactataaacatcaatatattaatcaaaacaagttgacgcctttgggaaaggaaatgactgtcgatggctttaattaaaaaagataacaatcaacaagttaaaattaagcatactgccaatgttgatcgcaacttaacccctagtaaaaagtttaagtccagtgaccggtgtactttaaaagttgatccacctgtttatcaacttattaaatcgttagcttacattactgataaaaagatgtatgaccttgttcgggaaatggcaaatgcttatttagaaaataacgttaatgatcgacaaagagagaatgttttacgaaatattgacgatattgagcattaaaaaaggagactaatacactaagaaaaaagtgtattagtctccttttgctttgtaatgattgcttcacactataatctcattaaattagcatgtcaataacaaaatatgcttagttccaaaaatagtagcttcaatacaaactaactataaggggtcaatggaacatccatacgaaaagtagcggtaggatcccgaacaaaaaatcagaaacgttgatttaacagcgtttctgattttttatattggctttatttaaaaagagctctggaacattcgtacgaaaagtagcggtagactttaaaaaccgaacaatcttatttttcgtctgcttcatccaatggtcttaaatgaccattttctaacgcttcattatattggaacgtgtacttaccgacaaagttaatgtgttcaaacatcagtggcgataatttgccgatcatgtcgtcagaacaatcaaacccttctgattgcatctgcgtcacaatcttttccaggtaaacggtattccaataaataatggcattcgtgactaaactgagagcgtttagttgttcttccataccatcaaaatacgtttgataaagcttccctttccgaccataaaagatgtttcgacaaagcgcgtgccgagcttcacctttatttagctgttccaaaatttgacgcgcataaatctcatctgaaagatagcgtaattgatgtttcgttttatagactttgccgtattcagtaatcgctttacccaaagcggttgggtggccttcacgttgcaaggcctgagttaattctgtcgcattgaccttaccagactttaacgaaccggccacgcgtaaaatatcctcccaatgttcttcaatcaaccttaaattaatgcggttttgagacaccccatttaagacttgataatcagcggtcgaatcaatccgccatagcttggttccctgactattagcaattcggggactgaactgaaaacctaataggccaaataagccaaagactaaatcgctataaccggcggtgtcggtcataatctgagtgggttccaaactgctgccttgatttaaaaagccttctaataggtagagagaatctcgtaaggtccctgcaaccaccatgccatgaaagccgatatattgatcagaaacaaaattgtaaaaagtaatcccgcgaccgcggccaaagtattttggattgctacgagaatataaagacctttggggggtaacgtaacgaatgccatcggccgaagccatttgaccgtcgccccagatgagcgcactttttaattttttatgcgcgttaataatgcggcgattggcggcggcaagggtatcaattcgcaagtattgatggtccacgtacattaaccgatcgtattttagactatttgaactgtttttagccactggcgaaaggccaatgttacaagcctcagctaataaaaccgctaaaatactaatatcaacgtgtttcatcttcgtcccactttcactaacgtgactaaaacattgtgttaactgtaactgttggttaacctccaagagaatatccgataaatcaattttgggaattaaatgccgaacccgacttttaaaggccgcttcgtccttttgttcacggactttgcgtaatttggccacaataattttttcttggccgtcaacctctttgacctgggccatttctgaatcagcccaattttttagggcctcggcataggataaagctaaatcctgtttcaccgcttcaacggctgcttgaccagtctgcggtaaatcaagttgttgaatcaaaacggccttttgttgacgccaagtagacttatcaattaagcaggccatgggatcaagatagcgattactttgccggacgtaaatatcatgacgcttaagaccatgaaccagaagctcgatgccggcaatcaacacacactgattggttacttgggggttctcacgaatataataacgccattttttcggtagtttttcgacgatctgttcaaacatccgataggtaaccgggcgcggaaaccgttggcgaataaactcccaaaccatcagacaatcttggccattggtagtcccttcaaaaacaatagtggctaaaatatccggaatgaatttccggaattttcgataagcatttaacagttcttcaatggcaattggttctcgctcattacgcactaactgattaacctgggtaacggctgactcaattatttcaggtggataagttgctaaaactttgtttctgagatcttgactgctgatcgtttcgtccatcaataacctgacaatctgggagagcgttaaagctgcatgatcaaaatctttaatggttcgcagccgttccttggcttctttatttttggcccgtttaaaaagcgtctcgtagaagcgtgaaagagctagtaattgttcatccatcgctcgtttgcgatactcggaaacaaaagcgaccaataacgccgtttgtcttttgacggacatccgtttaatcagactggccttggctttaaaagcatagttggccagattctttaactttcctgctggaattgcgcctaattgccaatcctcagttttaaattgttgaaactgttttaatcgagtaaagccacggttaatttctttgcggctttcatccatcaaaggatttcttaagagatccattttaatggtggccccatagatgggttccccaacggcagttaacagatttaaaagtcggtccgtttcttccgctgaagggacggccactaattgactatccaaaaggtcggcggcaacctccgtgaccccattaacaaagcgttcaaaggtggtcacccctggtaagagaattttttcatccaaacatttttttagcagcatatcaaaaagtagtttttcggtttcgtttgtaaaacgcgctcgctcaagcagccagtcgttcaggctcgctttgaccgcgggatcagtaaaggcttgataatgatattttcgcttaatcagcgccatatgttggctaatggtcatttttcgcgtgtagcctgctaatgcccgaccatcaatagttaactgtttagctaaataatcaattacctcagctgggacttgttgtagattagttggaaaagttcctaaaaatctaactgagctcaattgaacggcaaagcctaatttagtcgttgcggaacgcatttcatcaattaacgcgcgatcaaaatcagttaattgaaaatacagccgcagttgatcggcagaagagatgccctcaaaagttccgaagctttgttggtgatgcgggttagtcggcatattattctccaatgtttttaaaaaactatagtttttggaaaggtttcgctatactttgattaggttgatttaaccgggttttgagttttcaaaaactcattatcaaaaagtttataataaaccattgccaaaagatagctaaatttaccctggctatcaaaaaactaaggagtcactcatgattattggatatgcacgggtttcaaaagatgatcagaatctcaatcgccaaattgatcaattaatggcttatggtgccgaaaaaatcattcaagaaaagtttaccgggacccggcaaagaagaccgggaattacccagcttctccaaaccattcgggctcatgatgtcgtggtcgttgaaagtatttcccgcttgggccgcaatacgttggacattttaaatctgattcaattactgcaccaaaaacaaattaagtttgtttctttaaaggagcagatggacaccgagaccccaactggtcgagccatgctgcaaatgatgagtgtgattgcggaactggagcggaatttattagctgatcgggttaaagaagggattgcggccagtcgtcggcgtggcgtgacagttggccgaccacgaatcgcccaagaaaagttggatattgccattcggatgtatcaaagtggtgactattcagttaaagaaattttggccaccaaccaaatttcctcaggaactttttaccgcgaagtgaatcgattaaaactaaaaaagcttaaaagaaaagatgacccatctgcttctcacaactgacttctaaatattatggattccaaaaaagatttacgacctttagttttaacaaagttgacaagccattggagtagctcttatactatacatagatgatcgtctatgtaatggaaggagaaaaaatggattatcaaaattacgttcaaatgctaaaagcaatggctgacccgaaccgcctaaaaatcattgatctgctttcatgtggatcactttgtgcttgtgatatcctccagcattttgatttttctcaacccactttgtctcatcatatgaaggttttgcaaaatgcaggtattgtgtttgcggtaaaggatgggaaatggcaacactattccctacaaaaaaggtttgtccaagagtttaaacagaataccgaccaactgttagccgctgatgagcactgcctttgccaacggtctgattgtgaaaaagatgttgccaattaagtttttttaagcaatacatagacgcgtgtctatgtaaggagctgaaaaatgatggaaaagtattcgccacaagagattaatttaaccaagtacctattttttaccggcaagggtggggttggcaaaaccacggttgccagtgccactgcaattagcttagctgatgctggtcaccgagttatgatcgtttccactgatccagctagtaacttgcaggacgtttttaaagttagtttaaccaatcagccaaagccgattccaaacatttccggtttgtttgctgccaactttgatccggtcattgctgcgaacgagtatcgcgagcaggttattcaaccttatcgaggcgtgttgcccaaagaagccattcagaatatggctgaacaattatcaggctcgtgtacggttgaaattgctgcatttaatgaatttgccaactttctaactagttccaagattaatcagcaatttgactatattatttttgataccgcgccgaccggccataccttaagaatgctgcaattgccttctgcttggagtaattacctggataagaatgatcgtggtgcatcctgtctcggccaactagctggcttaaatgataagaaagctatgtatcaaaaagcggttgaaactttaggcaatcctcaagcgacgactttgtttttagttacccgaccacaaaaaggcgcccttctggaggcacaacgcgcttcacatgagttggcagccttaaacattaagaaccagcaactaatcattaacggtatcttaaatcagccaaccgacgcagtttctcagactatttttaaacaacagcaagctgatttgcagaatatgccagtcactttagaccagctacccaagttagcaatcccattgcgagcatacaacgtattgggattagctaatttacgactactattgaaagaccagcagccgcaaatcactgaggaaccggttactgctagtcactttcctgatctggatgttgtcgtgaagaatttagtgcagtcaaataaaaaaattatcttcaccatgggcaaaggtggcgttggtaaaacaaccgttgccgttcaaattgcccaaaagatagctgctcaacacaaaaccgtgcacttggctaccactgacccagctgatcatttgaaatacttcaaaatcacaagtccgctgatcaaggtgagccatattgatgagaaaaagtctttaaaagaatatcaaaacgaagttctcactactgctaaaaagaccatgaagtctaatgatgttgattatgtcgctgaagatttgcgttcaccatgtactcaagaaattgctgtcttccgagcttttgctgagttagtcgcccaaaatgatagtgacgtcgttgtggttgatacggctccgactggtcatacactcttactgttaaactcgacccaaagctatgctcaagaagttgcccatacctccggcagcgtcccacaagcagtcgttaatctgttaccaagactacaagatcctaagcaaactgaaattgttatggtaacgctaccagaagccacgccggtttatgaatcaatgcggttagatgacgatttgaagcgagccagtctagctcatacttggtgggtggtcaaccaaagtatgttggcaactcaaaccactgatccatgtttgctggctcgagtgcaaagcgaagttaaatggattgatcaggtaaaagagctttcgaataatcattttgctgttatgcaatggcaaccaaattacgaaaaaacgcttttaacggtttaattaattaaaggaaaaaaataattaatcagtttaggaggtatcatgcaagtcttttttgccgttggaattttcttactcacattattattcgttatctggcaacctagaggattatcaattggatggacagccgttggtggtgcaattttagcattattgtttggcgtggtgagttttaaagatgttggaacagttaccggaattgtctggaatgccaccttatctttcgtggctattattctgatttcactcattttagatcaaatcggattttttgaatgggccgccttacacatggctcgctgggcaaacggtcacggtattcgcatgtttattttggtgaccaccttaggcgccgtcgttgctgccctttttgctaatgatggggctgctctgattcttacccccattgttttagcaatggttcgtgccttacactttgatgaaaagcaagttttcccttttattattgccagtggctttattgccgataccacttctttaccaatgattgttagtaacttggtaaatattgtctctgcagacttttttggaatttccttttcagcgtatgcgttaagaatgtggattcctgatctattttcgctgttaggtagtattggtatcctgtatctttactttcgaaaagcattgccacaaaaatttgatgccactcaggttgcggaacccagttctgcactaaaagatcagcgacttttcaagttttcatgggtcgtcttaatcctcctattgattggttactttagtagcggtttcttaggaatccccgtctcctttatcgcactgagtattgcggctatttttctgatagttggtcaaagaagttcccatgttaatgcgatggcagcgattaaaggagctccttggaacattgtctttttctcaatcggtatgtatgtcgtagtctacggccttcagaacgttggtctaacaacattattatcaggtgtcattaccgaaatcgcaaaaggtggtcggtttgctgccacaatgggcatgggctacttagcagcacttttatcgtcattaatgaataacatgccgaccgtcatgattaatgcactatcaatcaaaggcgctgacgtttcagggctcatccatcatacgttagtgtacgcaaacataatcggctcagatttgggacctaagattaccccaattggctctttggctacattagtctggctacatgtgttagctcaaaagggagttaaaattaaatgggggacttattttaaaattggaattgtaaccacgatcccagtgttgtttattaccctatgtggcctctggttatcattatcgatttttggttagaaaatataaatcacaattactttggagatgaatagaatgaaaaaaatagagctttttgaaccagcaatgtgttgttcaaccggtgtttgtggtcccagcgttgataaggaattgattcaaacaacggccattcagcggtatgtcagtgtgaatgcacaggggcaggccatgttcattcgtcgtaatttagcccagaaccccgatgcctttgttcgaaatccgattgttgcccaagaactaaaacgtcagggtataaatgctttaccaattacgttagtggatggtcagttggtaaaaaccggtgaatacccaaccattaacgagtttagcagttacttagacatggatttagtagctgctttggttcactaatagtttagatggaggattaatgatgacacaaatttattttctatgtactggaaatgcttgtcgaagtcaaatggctgaaggattcgctaaaaaaattttaggcaatgattggcgcgttgccagtgcgggagtcgaggtgcatggcttgaatccattggctgttaaagttatggctgaaaaaggaatagatatttcccagcaaacatcaaagttaattgatcccgattatttgcttcacagtgacctagttgtcaccttatgtggagacgctcgtgatcgctgtccagtcaccccaccaacggtcaagaaaaagcattggccacttccagacccggctttagcagctggatccgaacaggatagaatagtagtttttcggaaggtcagagatcaaattgagcagcagattattgacttagcaaaagtcggtaacctctgaggaatcagtaggtccgtaaccaatacgaattttaaaatagcggtagaaaaccgtatattcagataataaacattctgagtgttcggcttcctaccgctacttttcgtatggatgttccattaacccctaattgaagccatttattcaactggcatgctaatcggcggcactatcattggcctctttggtaagtggcaggaccggatgaagcccgtaatcatcgcgtttttcctggttggcattccaaccggtattagcggcattttgccaggtaaccaaaccggatttttatggttcgcagctttaaacatcattgaaggaattgcgaccccattttttacaacgcttttaatggcaatgattcaacaaagttatccagcagaagagttagggcggattctaggcgttttgaattctttgttgaatctagctggaccaattggcttaatttttgccggtcccctagctgatgtgattggcattgaacgcctatttgtgattgcaggaatcggtgctgccatttgcggggtggtcgcggtgttaatgccaattaccaggcaatatgacattaggctgcatcaaaaattggcgaaattaactgagcaaccagataagtaattaacatgatgatcataaagaggagaaagaccagactaccagctgatctttctcctctttttgtcatcacttaattacacgtttttaatcttttcaccagtcaatcccatcgcattaattgccacgataattgtcgacatcgccatgaccgcagcaccaacggctgggtctagaatgattccaataaatgacaacacaccggcagcgagtggaattgcgacaatattgtagcctgctccccaccagagattttgaaccattttccgatttgtgattttagccaaatcaagaaaatgtaaaatatcgctgggttctgatttaaccaacacaacatcagcggaatcaatggcaacatcggttccggcaccaattgcaattccaatatcggccgcggcaagacttggtgcgtcatttacgccgtcaccaaccatgatgacgtgattgccctttgcttgataatcagcaataatcttttgcttatcatctggtaataggcctgcatggaattcagtcaatcctagtaagttagcaacgtgttccgcggcttttggattatcgccagtgagcattacgggggtaattcctcgcctctgaagaccactaattaattccttagcacccgctttgatggtgtcgccttcagcaaccattccttgaacttgggtgccctgcaataggaagctgacggaattacccttagcagcccatttatcagcagcggcctcgtcaaacctgatcccttgcttcgttaaatagttaccattaacaatcgtatagtcagtgccatcaacattaccggaaataccaacgcccggaatattttgagacttttcagccgcaacgacttcaatgtccttcgcttgggcttcagtaatgattgcttgggccagcggatgagtcgaattattttcaagggcggccagtcggcttaataacgttgtttcgtcaatcccatcatttggaatcaatgcattcaccgtaaatttaccttctgttaacgtgccagttttatccaagagaacgtggctaacatgttgacttgcttcaatggcttggcgatttcgaactaatagcccattttgagcgccaatcgtagtagaacgagaaaccactaatggaatcgctaatcctaatgcatgcgggcaagcaatcacgaagacggtcaccatgatcgtcattgcagtcgccaatccctggggtaaccaggcaaagaaagcaataatcccaacaccaaatgccgcgtaaaatagatacttggcaactaaatcagctttatcttctgctttagatttagcttgctgggcattttgaaccattttcattacttgagaaagatagccggagtcaccagtaccactaattttaaccgttagcgtcccgttattgttggttgcaccaccaatgaccttatcgccaacgttcttggtaacggcagcagattcaccggttaccagtgcttcattcacggtcgactccccagccgtaataacaccatcggctggaatactctcacctgaacgcacttggaaagcttgaccaacttttaaatcagatactggcacttcttttgtttcaccattatctgtaactagatgggccgtcttaggcaacagggccgccatcttttgtaaggcatccccagcccccatcaatgcattcatttcaatccagtggcctagaagcataattaaaatcagggttgcaagttcgaacgaaaaatccattacatgatttgccgggttcaagaagttgttggcaataaatgcgtacaaactgtagaaatacgaaacggaaattccaagggttactagcgtcatcatttcaggagatttattctgaatttccgctttagccccctttaaaaatggcattccgccataaaagtaaagtgctgtatcaaacaaaacgatgataatgccaacaattagcggtgaactgaaactaaggatggaaacgtttaaacccatgattggtgctaacagtaaaactggaatcgctaagacaacggagacccaaaatttaactttcaaattccccatatgcatcattgagccaccgtgcatcatcatgtcggtcccagccatatccatatcaccgtgattcatgttcatttggctgtgatccatttcggccatatcgtggtccatgttcatttgattatgatccgtttcggtcatatcgtgatccatatgactcatatttgattcattattttccatattcttagcactcatgtttttcatgttcatatggtcctctttatttgccatgattatcgaccccctaaaaataagtgtgcgtagcaaagcggttagaagccggaatataagttccttgtgtggaaatccccgggctcgggatttttccaccaggttcttatatttaggcttctgctttgcggagcaccatgccactatatgaatgagaattacgacaaaaattcataagtttccgccatcagaaatcccagattctggatttttgtgcagcaatcctaaaagtaaacagaacaccacagtcttaacacgtttgatcacctggcaagcagttacactgaacttcctcgggcgctgttttggccttttcagctagaatcgcctgtaagttcgcaatatccgcccgtgagagttcccttgactgaataacgccggcaattgttgaaccagcccgcatcgcacacatatggtcaaacaaatcatctgccgctgccgccattgattccttctcgccaacaaccggcttatacgtgaatggtcgactgccgccatgctgcgcaaccgcctgtttttgaatcaacctgtgaagtagcgttttggttgttgaagctgaccagccttctaattcgttcatagcatcgattagttcacgactagtcgcatgtcccattgtccaaattgctctcataaccatccattcagaatcggtgatggttacattctttgcatccttcaattggcttcctccattaattgaattctaagtttacgtttgtagcctcttaacacttattagtttacaactgtagtcacaataatgcaacctttctgccagaaaataccatgacattaaaaaaacgcctagataatattccaggcgtggtttgatacgatatgttaaattaatgatctgggaatttttggttttcttgttagtatggtgaaatgcctcttagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtgtcaatggcgtgaattaccgcacgatttcccggaatggcacactgtctaccgctattacgatgtgtggcgagataaaccagacccgacagcttctcaggaataatcaaatcatgattgggtttatcaaaaatcttgacataatttgtcataaaaacctcctaaatcctcaaacaccgtgctactgcattaagttttgttcgaccttgattaaggctgccattaatcgatcctgcgtcacacgatcaatgccgctaaagattctattattgacgtattctaaacgctcattcaacttgggaaccaatgcttttccagtgcttgtcaggctaattgaccaagagcggccatcggtctgtgaccgttgcttttgaacgtatcccagtctgattaattgttccaatcgcctcgtgacattactttgactcaggtaaattcgtttaaataattgatcctgtgttaaagttggtgcctggttaatttttaaaataaaataatagttactcgatgtcagcttcaacggttttaactgttcatccaaataggtttgcagctgacgtgaagccgtgttgattgttgcaatcaacccatcaatttctatatctgtcatcaataatcaccttctccatttatggctgacaaaattttagcattaattacttgcttgcgcaaacaagttgattcattatttccaactaaaaaagaccaggcttttatcggcctgatctccactaatcttcaaattgactctttccaagtttaaaatagccatgctataccaaatattgcaaatcactcgaaacagatggataggcaaaaatcatgtcctgaatctgctcattcgacagctttaagttcatcaccgagctgaaagcgtttagcaagtgctcaccaattgaggacaaaacgtcaaatccgacaatttgtttggtattggcatcccggatcaccattgccttggcaacatcatctttaatgcggttataggtataccaatgggttaaatcaaaggcacttacatgatatttttcaggtttgcttaatgcttcctgataaccaacccccacttgaccaacttccgttgtcccaaaaagaatctgtgggatgaccggatactgaattggtgctgttgtctttttcattaacaactcagcaacgtatcgtccttcaaatgaagcgacaggtgtcaatttgggcttggctttgtcaataacatccccgatggcataaatcgtcgatacgttggttcgcaaatgatcatccactaacacaccgcggctcgacgttttaaccccgcaattctccaattgtaattgatcactattcgccgatcggcctaccgcttcaactacataatcagaagccaacgtttcaagatcggtggtcagtgtataaccggtttcatttttagaaacagccttcagattctgattgaagtgaaaggtgatgccgtcatcaatcatgtcttgaaccagttgcgccacaaagggttgtggaaatgcctttaatggttgatcgttatgatgaataatatcaacatcactaccagccttattggcaatatttgccaactccatagatactaagccggcaccgacaaacgtgatatgctttggcagtgcatccaaatccaggaagtctgcactggtttttaggaatgatttaccgggaatatccaataaccgtggccggcgaccagtggccaaaatgacctcatccgcactcaccgtcgtctggtcacccagctgaatccgatgttggtccaaaaaggcagcctgcccatgatacgtatctatgccggcaccggacaatcctttttttgtaccacttgggatttgagacgtatatccccgtttaaaggccattaactgtttccaatcaatcgtgggaacgtcttttagtccgctttcctgcattcgggcaaccctatccttcgcctcaacagccgaatacagcatttttttaggatcacacccacgattgggacaggtcccgccaaaaagatcattttcaatgactaaaacagattttgacccaactaacccataagcagctgcagtccctgcaggaccggcaccaaagatgatgacatcgtaatgtgttttcaaagtacttcactcctcatataaaatcatgatttactttaattatagcccatcttggcctaaatcgtcggtattctcccaatcatttttgtcttcggattcgtatcatgcacagtcgagttgtataatgaaattctagtcaacttgttttcacacccaaggaggtgcctatccgtgtcgatcacagccatcattcatttttttacggccaacgccaagtttatcaacgcactcatggaacacgtttatctgacccttatctcattgatcattgcgattgtcattgccattccactggcggtttatgcacgtaatcaccgggtattcgctcatattgcactcggttttacgtcaatcatgcaaaccattccttctctggccatcttgggaattttgattccaattgtcggcattggcagtaaaccggccattattgcactggtcatatacggtattttacctatttacagcaatacatatactgcactcacaacgattgatcccaacttaaccgaagcggccgaagttttcggcttaaccaaatggcaacgactttttcgaatcgaattgcccctttccaaggacagtattttgaccggtattaaaacgtcaaccgttctgattattggaacggctactctggcagccctgattggcgccggtggtttgggaacctttattctgctgggaatcgaccgcagtaacactgctttaacgctgaccggtgcaattggctcagcactgcttgccgttgtttttagttggctcatcacccgattcggtcgtctaaaggccaaatcgatggtcattgtcggaggaaccgcccttttacttttgctgcttggcattatcgcaccaaaagtatacacggccactacccaaccggaaagaatcgtcattgccggtaaattaggttccgagccggatattttgattaatatgtatcgggacttgattgaagccgatgacaagaaaatagctgtcgacttaaaacctaatttcggtaaaaccagctttttattttcagctctaaagagcaatcaaatcaacatctacccggaatttaccggtaccgttcttgaagacatcattcccaacagcgaacgacagcttcaaaacaaatctgcaacgcaaatttatcatatggccaaagacgagcttgcggctaaatacaatatgacttatggttccccattaaattataacaatacctatacagtcgtcaccacccacaagttcgccaaacgacatcatcttcgcacaatcagtgacctcaaaaagcttcaaagccgtcttcacagcggctttgatttggaattcatgaatcgtgatgacggctataagggactcgtcaaaaaatatggcttatcctttaacaatactgatttggatcccgacttacgctatcaggctattcgccgtggccaggttcaggtaatcgacggctattcaaccgattctcaaattcgtcaataccacttggtttcgttgcgggataataagcatctctttccaacctatcaaggagcgccactcatgaccaaggcatttgccaaaaagcatccggccgtggtcaagcaactgcagcagttggccggaaaaattacggcaaaggagatgcgggagatgaactatgacgtcaacgtcaaaaaagtcagtgccgcaaaggttgcaaggcattatttacaacgccatcatctattaaggaagtgatcatatgccgaatacaccagtcattcaactttcaaatatttctgtcgtttatgatcagcaaaaagcaattgatgatttgtccttatcggtttatccgcacgaaatcatggtgctggttggcgaatccggtggcggtaagacaactattctgcgaaccatcagcggattagttaaaccggtaagtggacacattttagtcaacggactaacgctaaacgatcagaatttgagaaagattcgattaaacatgggctacgttctccagcagatttctctttttcctaatatgacaatcaagcaaaatttaacactgctacctgaaatcaaacaccagtcaaagactgcagtcgaccaaacgattaaagaattgatggctgccgcaaagttgccaatcggttatctgtcaaaatatcccaacgaattatcgggtggcgagcagcagcgggttggcatcatcagggcatttggtaccaagcccgacctgattttgatggacgaaccattcagtgcacttgaccctgtatcacgcgagcagttgcaggacctgacgctttccatccaccgacattttaacaacaccattttatttattacccatgatatgaacgaggcattaaaaatgggacagcaaatcggcgtcgtcaaagacgggcacattattcaactggatacaccggataaccttgtccgacacccaagcaacgactatgttaaaacactgttcaacggcagcgaagcccacaaaatcgaaaacgtctatattcgccggttggtcttggccgggtatggaagaaaaaccccgtttaagaagttaccggtcacttctgttgaaggagaccggacactgggcgactgttatcagctgcttgctcaaaatcagcagttagctgttagaagggacagtcaggtgatcggctatttaaattcggaaagcgttttaaactttttggccactaaagagacaaacaattagctgcctatcataaaaaagaggaggttggggcaaaattcaatttgccccagtctccttttaatcgacttaaccattagtagtcactattaaccacaaccacttttccaaaactatctgcttgatcaagagctgcttgcgcatcactggtatgaaccaaatcaaatatttttgccggtttaatgtcaatatggtgggtctcgacaagcttaatcagatcatttagatcggatgcatttgctgtatcagagctgaagtgggtcaaataagcccctgcaggaatcccaaacggatcaaaatcggcaactgtccatcgggcatcgtccatgccacttaattcaccggtgaaacaggtaatcccgttaacgttcaaatgggttaagaatccatcaatgtatccgggcctaccaattccaaaatggcatcaaaatggttttctgtttgaagccgtctctgatggtccaaaagggtatcatcataaccggctgctttcattcgagcaaatttttcgggatctcgagttattccggcaaccctgattcccggaccattgccttggcaagcctcatggcagccaccccgacgccactggtaccaccacgaatcagtaacgttttaacggctctatgatatttggtgttgatggataaaatccatcgacgccttttggtagattgtaaaattaatccgaacgctgttcggacaaaaaagatcagcttcctttaaaatggtgtttatttagtcgcttaaattatacataaaatgtgtccagattcttgacctaaatccaaaaccttccaaagcatcatccggagacaaaatacctattaacattaaaaaagcaagtgcacataaaatgatggcgttcggtgtggtaatttccatagccattagcacaaaagtaacagctaacgttattagcacaatcgcaatttgcaaagtcgtgtcatatcactccatttctaaaacttattagaagaaaattgaatttggaaattctcaaacacaaagttgtcctttactaattaaatgattttaaaatcggctttttgtgagaaatatcttttcatttcaaacgtcagttacttttaacgttgaagaaaattttaatatatacttatgaactaacgtgggagataaattgaggatttaacacgaagtttcgtcaaatttgaatacttcgtgaattgctaatgataattattagcaatttgcgagcaaaaagatgcgatctaagtcaaaactgactttgatcgcatctttaacaacatctattattcactttttttattccactccgaattcatttaaataaacactaaatggttgtaatgcttcggcttcataacgtcgcttgaaatcagcaatttcttgtgcagagcttgttgccggatctaattgtaatttttctgctggtaaaggtcgattattacgaattttcacatcaattataactgggccttcaactttaattgccgtatcaaaggccgcgaccaattcttcatgagtacaagctgtaatacctaaggcgcccattccttgtgcaatcattgcataatctgcaccctgcaagtcaacgccaaagaatttttgcttttcatcttcttgttcatctttaataaaatcaaagctttcatttgaaaaaacaacgttaatgatgtgtagtttttccttcacttgagttaaaacatcttgcatcaccattgaaaacgcaccgtcacccgtcaaattgaagacttgccgatcaggataagtcagctttcctgcaattgcagcacccacaccgtatcccatcgtagcaaacagggcagaagtggtaaatttttgttttggattcatattcaagaatcgcaaactgttcatcgtcacatcacccacatcaatcgcaaacacatcattaccagtggccacacgattaatttgtttgaaaactgaacctacttccaaaggctctgtttttttatcagctaattgttggagataggcacgccaattcttcatattagccacacaagcctcataaaaaggccgatgtgccacttctttactttgcgcgactaattggaccattgtttgtttggcatggctgagcaacggtacatccacatcatgtcgcttaccaattttggcagaatcaatgtcgacttgaataaattttgcttctggtttaaacagatccttcgtccgcccgaacggaaaatcagcaccgatcatcataatgaggtctgcttgctccaaagtttcattaccaggcttagtcgaaacccggtaagccgatcccatgttaccttcaaaatcatccggaataattccctttgaaattgacgacatcacaactggtagtttgagatgttttgccaaagcaatcaattcatcggttgcgcctttaactccgattcccgcaaaaatcacgggtcggtttgctgttgaaattagatcaatcgcctttttcaccatttgactatccggagctggtaaaactggttgcacataactatgtccagatgaccaaaactcgcttggaatttctttggttcccaagtcattaggaatcgtgactactgccacgccattttctttatatgcccgccgaattgcttcgtccaccacatgtggcaagctttccgccgtcatgactgttcggttataaacagaaacatccgcaaacattggattttcattcatttcttggaaagaatcccagttcatgtcagcagtcctaacctgcccaattagtgccaatactggcacatgatccatttgggcatcatacaaaccattaaataaatgcgtggcaccaggaccagctgatccgaaacaaacgcctaactttccagttaattttgcatgggctgtggcagcgaacgcaccaatttcttcatgacgaacctgaatataagcaatcttatccttttcgactcgtaacgcatccatcgtactattaattgatccgcctggaatgccgtaaacctgctgaacatcccagtcttcgagtactttcatcatcgcaataccagcattaattgtttcacccattattaatccttctttctagttttgatttattgtcgttataactgcatacctatgggtgtagtatctcatgaagtaaatacgcgtgtaaaagaaaacgctctcattagtttatacaaaaaatgagaccacaacaaaacctatgtcttcgttgcgatctcgttcatatttccaaaatgttatttttaaaccgtaaaaaaaagcagattctgagcctagtcacaactatgctcagaatccgaccgtcttttttcactttcatttttctagttattatagagtttgaaaaattaaccaaacgtttaaaataactaggacaattgcagcaacccaagcacagacattgacccatgttcggttggcaaactcacccatcagtttcttgctacccgtaaaaataattagtgggatcattgcaaacggtaatgccacactcaaaaatacctgtgagaacgtcagtaagttttcaatttgtgattcatttccgtgatagtaaatggcaaatcctaaaacaggaataatggccagcaaccgggttaacaaacgctgtgcccataacggcatccgcaaccgaatgaaaccttccatgataatctgtccagacaaggttccagtaatagtggagctttgaccagatgataacaaggcaaccgcaaacagcatactcagtgccggacttgcgaccgcaccaacaatttttgaattacctaaagcgttgtataagtcgacgaaacggcctaagtctgaattggtaccaaagaacaatgcagctcctaaaatcaaaagtaaacagttgacgacaaaagccatcgttaattgcatattggaatcagcgactgtgtaccgaattgcactgcgcacactcttccgatcattacgatcaaaattacgtgtttgagaaatggatgaacccaagtacaaattatgaggcataaccgtggcacccacaattcctaagccaatatacaacattgatttgttcgcaataatatcttttccgggaacaaatccacgcagaatttctggtacatttggttgtgccaaaataacttcatacaagaaaacaaagagaattacagcaaccagtgtcgctacgattgcttcaatttttcgaaatcctagtttcattaacagcaatagcagcaaaacatcaaatgctgtaatgataataccgacaatcagtgggaacccaaacagcagctccaacgcaatccctgatccaataatttccgcaatatcggtagccataatggctagttctgtgataataaatagaatgataccaccgagtttggaagtcttttctcgggtaagttgcgctaaatcacgaccagttacaattcccagccgagcagccattgcttgtaacagcatcgcgattaaacttgaaatcaagatgacactaattaaccggtatttaaactgagctccaccagaaattgaagtaatccagttacctgggtccatatatcctactgaaactaaaactccaggtcctaagtacgccaaaaatgtttttagaactcctgcattttgcggaacttcgacacttccgttaatttcatctaaagatttactcgcgccaccagtagatgagatcatgtggtgtgttttgtgacctgttgttgaatccttttgtaccgaactcccctgtactgcttgtgactgtccgtcaccattttggatctttacttctttaatattgtcttggttgtctttctttgccatggcatttcctcttttctaacattctcaaaatccaatctctgaattatcgaactacgattacggaaacgtgtgcccgttttgcaattcttaatcctaccgctcctggtacacggtggcttgcatcctctgtatcagatccgcaaacaatcaaatccggtttaaactttggaataactctttctaatataacatcatctacatcaccagcaccaacagttaatccagtcacatgctcagcacccagtttttcggcaatcgtcatataatcttcaaccgtttggcgaacatcatcttcctttttgtcgatcttacctggtgtcatcacatcaaaaatgcttacatcatcgtcttctaaaacggagacaatacataattcaatctgataatcatgtgccattgtcgctgcataacgaaatgcccggatcgaagaatttggatcatcagcatccacagtcaataacacgcgacggaaaacaagtggttgactcaattcactagcttgcataacaaacctcctcatttttggtttcattagtgtttttaaatcaccatattcaacctgtattcagatggcttcagttttttaccaattaaatgatattaacacttaaaacaatagatttccacaaaaagataaacgcaaattaaaaaaagtaaatataagtttattttaattttaggttagtcttatttttttaaaaaaagctttgtcatctaaaaaagcatccgctcatttttgaacgaatgctttgcaagtttaataattaattttttgaaacaactgaagaagccgaatcagtcaaacttttctttgctacatgggtacgtgtacttttattaataataacggtaatcaaagccacggccgcaaacacactcaaaatgaggtaatcaattgcagaaccttggcgggtttccgcaacagttgagccaccatgcaattccaatgaactgacaacggaagccaaaattacggttcccatagcgccagcatactgctgcatcatgttaaacaaggaattaatatcccctcttttttctggcacaacttgttgactggcagctcccataacgtttccgaaactgaaagccacaccaattctaagaataacaaacaaggccaatagaatcattgaagtcatcacattgtttaagaagaagaacaaaacaactgatgccaacaaacaaatattacccaccatcaatggtaagaaggcaccctttttatccataattgaaccggtacttggcgaaataattgcgccgatcaaggccccaggtaaaactaataatccggcaaccatagaactttgatgtaagtttacttcagcaaccattggtaacaaccatgaaattccaatatttacgaaggctaatacaaagtagtttaccaaatgaagccaaacggcttttttctttaacagtccaaagtccaaaacttcacgggcactctttgaattgtaccaagcataactagctaataataaaattgaaatgattagagaaatccaaaatgctgctgaagtccaaccggcaagtcctgcttcattaaatgtccacacaaatccgattaggactaaactcaaccaaaccatgccaaaaccatcaaatgataatttttcgccatctttatgctgaacaggaatatcgatactgctcattcccatgattaacacgatgatacttagaggtaaaacaacccagaagatccatcgccagttgattaaagtgtttaaaattccgccatatgtcggtcctaaagctggtgacaatgaagttagcatacttgcaactccgttataagtcccaacgtgttgacttggaatctttacattaataatttggaacatcaaaggcgttgctagtccggttgcaacggccttaatcatccggccaatcagtaataaccaaaatgtgccggcaatcgcacaaacaatcgagcccactataaacgccgttgctgaaaaaataaaaatcgaacggaatttaaacttccgcatgatgaacgccattgctgccatcatgattgtgactaagagcagataagcagttgtaatccactgaactgttcccacactcacgttaaactgattgcttagtgtattcattgtgacgttcaacgaagtttcaaccaaaatacccataaatgagatcattccggccgagacaatcgctaatcttgttttcaatgaaatcttattttcatccatcttgtcgcccatctccttgatttattctgttatttttataaaatacgaataatttcaaaacacaaaggcacatccagcttcggcactgccttgctgtcgtgtccttgaatgactctttttttcttatactcttttaggacagtttctgaagacaacctcagtattataaacgcacctagcgcgggacctcatcccgctgacggtgcgcttataatactgaggttaactccgtcttcatccactcacttttccgctgagctctaggaccgctcacggaggcagtcctttaaaaataactatgactcccgcgggattgcgattccgcatacgtcacagttatatttcctctttaatgtttttttccactgagctctaggaccgctcgcaggagcaaccttctaaatataactatgattcctgcgggattacgatcccgcctccatcacagttatatttagaaggttaacgctcctgctcgcgcactctaactccatctctcatccacctcatttggaattccgaacgcatctaatatcttcatcgtctggtggttcaccaaatcctgaatcgtctttggatgattataaaacgctggtaccggcggaattatttgtgcccctaccttcgccaacttcgtcaagttttccaaatgaatcacactcaatggcgtctctcttggcacaattatcagttttctctgttcctttatcgcaacatctgcagcgcgcgcaatcaaattatcgccaattccatacgcaatcgttgccaccgtcttcatacttgccggcacaatcaccatcccatcattcagaaacgaaccactcgcaatggccgcaccctgatcattgctatggtaaaccttgtcagccaatgcattaatctgactcaatgaataatctgtttctaactccaaatttttctttgcccactgactcatcaccaaatgaacctctacattgtctaatcgatgcaacttttccaacaagttaattgcatatatggtgcctgaagcacctgtcactccgacgataatttttttcatgtttgcaccttctcacggtatgacttttcgaaaattgtagttttaataaaatagtctgggtaaccaaactttctatttttatagccgaaacgtgttaaagagagcaacttcctccacttgccagttcttgcggcttggtttgaagccacaagaatggtcatcgcccggaacatcaaagattattagtgatttttgctaaaaatcttccttaatgtggagtagtgccagttcttgcggcttggtttgaagccacaagaatggtcatcgcccggaacatcaaagattattagtgatttttgctaataatctttcttaatgtggagtagtgccagttcttgcggcttggtttgaagccacaagaatggtcatctcccggaacataaaggattatctgcgttctttgctaataatcttccttaatgtggagtagtgctatttgctctttctacccttatagctgaaacgtgtttaaaaaggcagcttcctccgcttagctacggtaaactaaacgattcctaaaccgaatcattcagttacctaggctaatgctcagaagctatctgccttttgaaacactctactttaagtacttctcccaatccttcacttctttaaattgggcccgttcaaactgatccttcatatcaaatggcaccgttccatcaatcaccaatttcgatgacattcctcgtgtccgaattgactttggatcatactctggtcgctccgatggatccaatggatgatttcgcattcccggcaacaccataatatcttgatctgcttggaatcttgtatttatcgtccacaccacatcattcatatcaaagatatccacatcttcatccaccaagaacactgtcttcaattccttgaatgatgaaaatgctaataaggctgcctgacgttgaattccttcatccgcctcattatccttatgaatctgcatgatggtcatcaacttaccaccacctgctggaggattgtacacattcaatacctttccaggaattgctcggtttgttaaggacaaaatacttgcttcagttgggatacctgccatgctgacatgttcctcagaaggtccaataacactttgcataatcggatgttctttacgatgagtaaccgctgtaaccttgatcacttgcaatgctggattagcatcaccatcgtatccaggaaattctggcattgccttacctgtatgcgtattaatatcttcttgaatgcgctcgtttggcataatgtagccttccaaagtgtactcagaacgagctaatgctttttcatcaacagttaatccatcaactaattgcactggctcttgacgaatagcaccagcaacacccaattcgttataacccaatggtgttgtcggtggctcaaaggtcgctccaattgttatcgcaggatccagaccaatattaattgtaattggcattggtttgttcattttttcatattcttcagcaaatgccccgatatgacggccaccaggcataatgtaaatgcctaacttgtctttatcttccaaaaccatacgatgaattgtgacatcactcatggtcttgtctggattggaaccataaaccaccccaacagtgatgtatggacccgcatccattggtgtgtttgttggtgcagcaaccaatttacgaatatcaaaatcagcatccgtagacttatgcacaacttcatgagctggtgcgtcttcttcagcaactgtcacaggtgccactggattttcaacagaatcgtttaaaaactgacccaatgtgtgataatcgtgatggaacatcttcccaacccgtttacgacttgccatcaagcccatcaaaacacgtgtatcgggtaatcccttgacgttattaaacatcatcgctggaccttcttgagtaggacgttcaacagtcccaccggcaccaatataacgataaacgccagataattcagcatctggatcaacttcaacatcagtttcatgatattgacccggttcttgttttaattcatcaagaactttacgcaaatcataaacatctttttttgccataatcaatgacctccaatttttaattcttttaaaaatctcgtaaattgtgaaatcttcttacgtttgtcattatatgagtgcaaatccttgcgaacaaatcgcatttcgactagcattattcccaacaggaataatagaattgaggctgacttatgacgattgaagatttaaaagattttgtggctttatatcaaactcgcaacgtttcggatgctgctgttgagttattaatgacacagtccgctttatccaaacgcattcatgccatggaagacgaattgaccaccaaattgatttccacgaaaaataaacgtcacttggtcattactgaaagtggcgaggttttttttaggtatgctgaaacaattttgacgcagtatgatttgctcactcaagaactttcggaatatcgagagctcaaaaaaggaaccctgcacattggcagtgttccggtgatgtcacagtatggactaatgacaaaaatgagccaattcatggcagattatccacaaattaatattcgtcttgaagaactagaaggcgttgatttgttggaaaagctccaatccaaacagcttgatcttggtattttgcgtaatgtccagacccagttattaaataaatcgcaattccattttatcgatatcgatcaagacgaactcaaagtcgttctgcctgccaatcatcgccttgctaagcaagaccagatttcaattgaagacttacgcgatattgatgtcgttgttttaagtcccggttctgggatctatgaacggatcggcaaactttatcaacaagccggtttcacacccaatattcgattcacaactactcatattgaaactttaatgggaattattgaaaactcgcaacgtgtcactttcttatttcaaaaatcagcagagccgtttatgagcgacaaatttgtcacccgttccttttcgacacctatatataacaaactgcaattagtctaccctcaagggacactaactcaggcaggacgacggtttattaactatataacccatgcatcccagccaattcacaaatcttaataatttttttgtttcaactctccttttttgtggtaaactcatcaacaattcaatgtcacttagccgcttttaaaaaggagatttgaaatggcaaacagagttacaaggaattttatcgataatttaccaaaggcagaattgcatgttcatttagaaggcacactagaacctgagttgcgccttaaattagcgcgtaagaatcacattgatatcggtacagattcgcttgaaactctaaaagcaacctatcattacgataccttagctttatttttagctgtatattattcggcgttggatgttttacaaactgaatcagatttttatgatttagcttttacttatctcaaaaaagttcacgaaaacaacgtgcaacatgttgagatgttttttgatccccaagctcataccagtcggaaaattagttttgaaacggtcatcaacggcttttcaaaggcagcagaagatgcaaaaaaattcggtgtagacgctcaattaatcatgtgttttctgcgtgatttttctaaagaatcagctcggaaaagtttagaagctgctaaaccttaccaagacaaaattttgggaatcgggcttgattcagacgaacataataatccgccgttgaaatttgccacagcgtttgacaatgcggtatctgaaggctatcacatcaccatgcatgccgatgttgatcaagtcgattccatcgatcacattaagcaggcgctggaaattattggtgtggaacgtttagatcacggtacaaatatcgttgagaatcctgatttagttgatttcgtgagcaccaataaaattgggttgacctcttgtcccaattccaatcaatttcttagccaagatatgaagggtgctgaagtcaaaaccttgctggatcgcgatgtgaaagtaagtatcaactcagacgatcccgcctactttggtggttacatcaacgataactactggtccatcacaaaaaattatgagctgacgcaggaacaagtggtgcaattagccaagaactcatttgaaaccgcctggatcagcgatagccaaaaaaataattgtatgaaacaaatcgataattatgtcgccaattttgattaaaaaaggttaataaaaaggttcggaaaatttgaagtgccccgtaattgttagacataaatctgacagttgtgaggcgcttcattttattttccaaacctttaagttttgatagccgaaacgtgttaaagagagcaacttcctccgcttgccagttcttgcggtctgaacttcggccacaagaatggacatcatccgaaacataaaagattattagcgttatttgctaataatcctctttaatgtggagtagtgccagttgtgctttctatctttatagccgaaacgtgttaaaaaaggcagcttcttccgcttagctacggaaaagcaacgattccaagtacgaatcattgctcttcctaggctaatgctcagaagctattcgcctttttgaacactctttttattttcttcttctccgccgacttcttgtctcaggctccgacacatcttcttcatcttccgacacttgtggatgccgacttgcccgcgttggccgttcttcttgcttcgttacttcttggtcagcagttaccttactatgctgggacaaatacacaattgcacccaaaattaagattgctggcaccaaaattgccgaatcctgcaaccacggcacaaaaatgcccgaaacaaatgcgccaaccataaaactgcccaccacaataccagtatcagcagccttttgttttgcaaccgtgtcatgccgcatatagccagtatacaaattttctgcagccgttcgaatatttcccgtcatcatcaaagaagtgaacggtccatcttgtaactttcgaaactcctgtaattgagctgccgccgtaatggctagcaacatcacggtaatcacatctggtgcattactactgatcatggccaccaaaaccatcaaagcaaactcatagattaaaacaaagtaggcccgttttaaatagtttcgcttaaagtaatgctggacgtgccgaataaatacggtacccagtccaaatgcaataatcgcaattaaatagtaatcgaattttgcaaaatgacccttactcaaactgactcccattaaaattaggtttccagtttggagcccagcaaacacaccgccatgttctaagtatgtgtacgcatctaagcccccagcaatggctgctaaaaatgcgccgaaatatagttgctggtaggcaggataagcttgtctcctcaaaaaaatggtcccctttctctcttatgtttaaatccttttgaattcatgaaaattgatcaacatatttcagtgtagcatgaaccgcattcagactaaaataattatttaagacgttaattattctttaaaaattgtataattggatgaaaccgttttataaccactaaatatcgaaatgaggttcagtcatgcacaaaaaatacacttggcgaacagccgaaaaaacaatttatccaatcaaaaaagcgccttcaattgccaccctaccaacacaaaccttcatcacaatttctggttccggaaacccaaatagtgacgcatttggcagaaaaattgccgctttatatgccgttagctacgcaattagaatggcaccaaaaaaaggcatccactttcctggctcctttgaatataccgtttaccccttggaaggcttttggacgttaccagaaaattatcacagtaacgagttagataaaaatcagctggtttatcaaattatgattaaacaacctaacttcatcacaccagctgtttttgaccaagcgctaaatttggcaaaacccaaaattgattccgagctatttagtcaactttctttagaaactaaacaagaaaagacagttgggatgatcttacacgttggctcttttgatgacgaacctgctagttttgcgaagctggcacagttcttggatgagcaaggttataagcgcactagtaaagctcataaagagatttatctttctgattttagaaaagtaactgaggataaacgtaaaacgattctacgagtatctataacgaaaaaataaaaaagtgaaacaaaactcgtctcacttttatcgtcatttaaacgatttaagaaccatcctataaaatttcatcactaattttttggaacgcaaactcgcagcaggcttcacgaaattcgtttcgtttgagttcaggttgatgtaaatcatatgcatcagtctggccttgaaaactaatcccaatccaggcagttccagccttttcgccctcaagtccagttggccctgctgctcccgtaaatgaaacggcaagatcagtattgagggctttttgcgcaccttgtgccatagcaacagccacttcaaaactaacaacaccatactgttgaataagcgatgccggcacatttaaaagttgtgttttaactgcatctgaataggtcacaaatccacctgtaaaaataccagagctccccggaacggatgtgatttctgattgaaataatccgccagttaggctttctgccgctgtaattgaaatatttttttcgattaaactttttaccacataattaactaatttagcgttcatgaatgatcatcccttcaagtccttttgatttcagtttacctttctgctccagaattaccactataaaatcaaaaaaacgttgtcatccaacatcaggaaaggcaacgtttttaaatgattactttttaattcgaatattttcttcatgtaccgcctgtacaaccggatgtttcgcaaaataatcactaatcaattcggtcatatcaatttgaacttcacgcacaattttactcgcggcaaacatctgataatcaccgccaccaattccacgatattggtttaacgtcacttccagtttctgatcatcgtgcaccggtttgccatgataactcaacgcaattacccgctgattttccggtttggttaaatcaaacgcataattaatgccgctatagatatcgtaattatacaattgtagcttgggttcccggaacttagctgaaactgcgacctgaccttttgaatcaaccatgaagaaacttgcacaccgttccaacactcgttttaaatcggtacccgtaactttcaaaacaaccagcgtatttggataaacatagctattcacgatattacgcatcgtgacggtcggatcatagcccaacacttcatcattaaacaaagcggttgctgataaatcagtatgggtcgctgccatttgaacctgattaataaaactcaagtagggatgaccaaccagacgagccgtcataggatccgtaattttcatattaccgataacttctcccattggcgcatctagccagtcttcaacgtcgtcttgtaaatcagaagttagcttttcaaactttacggctggttgcacatcggccacagaaattagatgagcatcttgtgtttgaatctggtgctgagcattcaaattcaactcgattgcgccaacaaatttacctttttcgcctggttgggttgtcggcacaccctggcaaatggtggcgatttctcgatgttggtgccctgtcactaatgcatcaattccggccacttctttcaataattggtagccctcgttttctcctgtaagccgttcactaggtttaccagtttccaaatcacactcaaagccaccatgataggccacaatcacgatatcgacttgttctcgcaatatgggaacccattttttggcagccttaattgctgattcaaaacaccaacctgcaatgtgatccgcttgctcccaatgaggaatatattgcgttgttaatcctaaaatacctacttttaatccgtgatgttccagaattttatacggggcatcaatgacgccatcgccgggattctctttcaaattagcagccaaaatgggataacgacgcccagtttcacactgctgtagatacgccatgccataattgaattcatgattccccaaaatacctgcgtcgtaacccaccgcattcgtcagtcgggtatagatagaccgccatttagcctgcttttttgcagtgaaataggttaacggtgagccttgaataaagtcgccattttcaatggtgatcacccattcgtcagccgcggcttgttgtttaatttgctcaattttagtcgctacttttaaaaaaccatattcttcatgatcggtgcgctgactatagtttgtaggatagaggtagccatgtacatcacttgttgataaaattgtgagtttcattgcctacaccagccgtttccgaagcgttcctgaaataaaatcgatcaaggtgaccgtaatgataatacccagtaaaataatccccactcgtgaccaagtccgcgtttggatggcgaaaagaagtggtgtgccaattccaccagccccaaccatccctaaaatagaagctgatcgtaccgcaatttcaaatcggtacaaagtgtatgataaaaactctggtaaaaccgttggcaaagttgcaaataccaatgtctgtgaacgattgccaccgctactcatgagggcttcactaggtccaaaatccatattttcaatcgattcactaaacaactttcctaacatcccaatggagtgaatgctgacggccaaaacaccagcaaacgaccccggcccaactgctttaataaacatgatagccaagacgatttcgggaaaagtccgaatcaaagtcaggactagtttgcctgaagttgaccgaatgtgaaaccgtggcttacctgtccgagccgcccaaaaagcaaacggcacactcaagatggccgaaataaaagtccctaaaaacgccattgcaatagtttgcaaaatcaggcttaccagatcttcgccactgccatcatagacgtacttccaatctggatgaaaaatcccataggcaattgaacgggaaacttcacccgcagaatctttaatccccgtaaattgcacaccagtaataccccaaatataaatcacggcaatgatcaccaaccaaaacaaccatttataccgtttagaccgcaacgatgtctgattcactgttagttgtttcatagtaatcgctccctcaacgtattgctgacgccatcaataattagaaccacaactaagattcctaaaataatgatcgccgtttggccataagcaaactgatctaaggatcgttgtaaatacaccccaatcccgccggcacctaagtaaccaaggacggttgaagcccgcacattaatttcaaacgtatacaagaaataacttacaaaatagttaaatacttgaggaatgactgcaaacacaaccaactgtgttttgttggcacccgccgcctgtagcgcttctaatggtccctcatcaatcgtttcaattgcttcataaaatagtttggaaatcatcccaaaggagaagatggctagtgtaaacacaccggcaacgggaccgattccgacaatggccacaaacaatgcagccaacatcaaatccggtaacgtccgtactaaatttaaaataaaccgaataatgccacggagaaatttatttttcacgatgttccgggctgctaaaaccgaaaatggaatggcaactagggttcccactgtggtcccgatcaacgccatttggatggtttctaagatgggttgcaccaccaaacttgtgtactgccaatctggtttagccatttgctgcaaaagcacaacgaactgaccaaaatttgcaaaaaacatgacaaagtcaacgccagtcatctttgcggtgccaataactaatagaacaaatagcgtcagccaagcaatcgttttaacatgatacttctgcgcaaaggttcgcgttgggacaatattcatgcttgcacctcgcttttctttacaatactgacaggttgataaatggcctccaaatctttttcggtcactttgctgatgggttcgtcgtaaacaagctcaccatcacgcaacccgataatacgatcagcaaagcgcttagccaaagacaccgaatgcaaattcacaattacagtaatatgaaactcctcatttaatcgttttaaatcatccatcacagattcagtcgtcagcggatccagcgaggcaattggttcatccgccaaaacaattttaggatcctgcataaacgcccgggcaatcgcaacccgttgttgttgaccacccgataattcatccgcccgactatagagtttttcaccaagacccactcgttgcaaagcttcaatcgctttttgtttatcttcttttgaaaataatcccaacgtgctcttccatgtggaataataccctactcttcctgataaaacgttgcgttgcacactagaacgtttgactaaattaaagttttgaaaaatcatgccaatactgcgccgcaatccccgcaattctttgccttttagatgcacaatcgattcaccatctacccgaatgtcacctgttgaaatatcgtgcatccgattaattgtgcgcatcaacgtacttttcccggcacccgaaaggcccacaacgacgagaaactggcctttagggatggacaagttaatatctttcaaacccaaggtaccgttctgataagttttagaaacatgtttaaactcgattattggttcgtctgtcatattcaggattcctttcgtttatccaaacttgcaagaaaagggagcacgcactcggcgtccccctttcctaaactgaactgtctttgaagactatttatttaatttcttagctgtcttgtcatatgcccgaattgcattgtagtcgctatccttggcagtgacgtagttttcatgtgaataaactgatgaaatgattgcgtggcccttcttggtcttggcaattgccttaaaggctttagaaatctttttatcccacttgctactcatatcaccacgaacagtaatcgtatcgtttggaatacccttcgttgtatagattggcacaacctttttcatgacatctttagcatctttttcaacaagcaaacgggcgccttggaagacaaaggccgcatccgcatcgccattataaacggccatgacaccttgatcatgtcccttaacctgaaccgttttaatgttgtccttgttaatattgataccatgtcgataaagttcaaccgctggataaatccaacctgcagaagaagtggtatcttgaaccgcaatcttcttgccctttaaatccttgattgacttaatgccactacctttgcgaactaaaatctgagctttgtaactgttgaccaacgtattggtaatctggtcattaggttccttgtatccgtatcgctgagctttcaacaaaacctttgcgttatattgtttgtgagccaaaacgtatgcgtctggtggcaagaaaccaacatcaaccttcttagaacccattgcttcgaccatcgtattgtagtctgttgaaacggaaaccttaactggaattccgagttgtttctttaacaagccttccaatggtttcgcctttgcttcaatagtgctggcatttgaagacggaacaaactgaaccgtcaactttttcggtgtataggatttgctggccgaactacttgaactcttcccgcaagctcccaaaacaaaaacaagtgatagtgccccaacaactgtagccaatcgtttaaacattcgcatcaaagtgtctccccttttgattgtatttgacaagttcagtgtatctcatagtccgaacgatttcaataacatttacaaaaattgttaagttttcaccaaattaaactgtttacataactttcagtaccatccatttatttgaaagccgaatgaaaacacaccgagagagccaaattgatcacatatcgccatttagggggtaatttgtcgtcaaaatcgggactacaatttaacccgattcatccgaaaccacttatgggtgttgctttcatagacaaagcttcttcacttatgggggttgtaatgcctgtttctagggcgcaaaaacggaatgccaaacaaggccgacctatttttgcataaaaaagtcccctcaatctaatttgagaggaggaattatatttatatctcatttgattacagtttccgaatcatatcaagatggggaataccagtatctaaatacacatcactagtcgcttcgaattcaaacgattcgtaaaactgctgtaaataagcctgagcttgaattttaatggtcgtgattttaggcatttccgcttgaaccacctgaataccagccgttaagagttgacggccatacccatgttttcgaaaatttggatcaattaccacgcggccaattcggattgctgtgtggtcagtttctggaattaacctcaaataacccactaaatttccagtatcatcatgcatttgcaaatgtttagaaaccaaatctgcctcatcgacttctggataggcacaattttgttccaccacaaaaacatcggtacgcaatttataaattttaaagagttccatattcgttaattctgaaaaagctttgactgtaactttcattttatgctcctcgaccgttggctagctttcattgaacttcagtatttcctgcaattgaagttcatttatcatattccgacaatacctgttttaaaaagcgttgatagttttcgacaaaatcaggtggtccaattaccttgatgtgagagccgaagcccgccaaatagcggtaaccaaattcatgatagggcacggtaatttccgcataatagtgctgattatcaatctcactgagaaccttggcgccatagcgttccacaaattggtcgcgaaccgtcgcatctattttaactttaattggaatgttcggaaacggaaaataagttttagccagctgccacttagtcttaaacttccgttgcgtaaatttcgtagacaactgttttacattcgtaattcgagaaattttatacgttaggaatgcctgcttttctagaacataaccttgtaaataccaacgcgtttccttggcctgtaactgatagggctccaccgtttgccttattttactgccgtcaacatcaatgtatgtaaatttaaccaaatattgtgacttgatggcgtgttgaagagcgtccatcatttctgctatctcggtacgccctgaccactgctgaaacgagatcgagacggacttttgtgtgatttcatgaggaatcatgcttcggattttctcgagtgtcgctttaatgtcatcattcaacatgagactttgaaaaccatttaacgcaatcaaaatgttttccaaatctgtcacagataaaaggcgtttgtcgaacttataagctggcattaagccgtagcccccatgactgctccgcaacgcatagacgggaatgttggccagcgccagcgtatccatatctcgtaaaatggtgcgtttggtcactttaaataaatctgcaaattcctgtgcagagatcacgtcgcgctctaacaacatcataactatcgcgattagtcgttcaattttcattttatttccaccaattttcattgatgacagacacctgtcacctttaatacagtatactatcgctatattaaaaaaggagatcttctaaatgacttttgaaatcataaaattaccggaacaactctttgctggaatcacaacggtactgcccacgccagaatcttttgacgatatttcggcactcagtaaggtgaaagctgaatatttggacaaattcaaaaaagatgctgcaaagttaagtggcggtgcacaagatgataatatctatggcattaactttaatgatgctaatcaaaactatctagttggtgtcaaagttaccaaagttcccgctggaacagcaagcttctccactccagcaacaacctttgcaaaattcacgaccaaagctaccgaccgtccccagattgatcaattcatcggtgctgcttatggcgaactgtcgcaatccgctaaatatggaattggtggtaactacaacgtagagattgtgaacaattttgtgaaagatgccgatacgtttacgttgcttttgccggcgatggaaaaataaagtgaccataatgaaaagcgcccttcaaatataagggcgctcttttcatatattgattttggcactcttaagaatacgttttttgcacaattaaaagttcataaatctcttatctagatcgattcgacaataaaagtcctgcaagcactacagtcaatatgtttgacaacacttgcaaaccactgtttgagtttcctgaaacgttcaaaattaaggagacgatagccaccagtattgtaattacggctaaccatttaatttttttactcatagctctttccctccttttattagtcacttgtaaaacaagtattcattaatagtaatagttgcttcctttgctcttaactatattgattcgacactcttctaaaactacagtgccagccagtgaattgtagctagtgctcttaactatattgattcgacactcttctaaaacgttcatcgatatataaattttccattttaagctcttaactatattgattcgacactcttccaaaactccaaggttagataatgcaaccgagttaataaagttttcaacttcggctttagtcttgcggtcgccattattgaagcggccgatttcttgaccgtctgaataggcaacaaaacttggaatgcccataatgcccattttaccggcaagatcgatattttcatcacgatcaacctgtaagaatgtgtactctggatattcggcttcaattgcaggcattgccggcttgatgaagcggcagtccgggcaccagtcagcggtgaagaacagcatatacttgccgttctcaagttgtttggttaaatcttttaaattggttttaggtaaattttgcaaaattatcatcctttcacttactaatgtaaagtacatcatagcacaaatttccgaccagccaaatcagtttgctcatccgctgctaatagtctaaagtatacatatcatatacaaaaaaggtgaaatgatgaaaaaacaaaccgtcttctatagcctggcactcgcagcctttgccggcagtgcctatttcgtggccaagtccgatcgcaaacacgaaaagtttttagcagctatcgtcaaggataccaaacaatcagccgcattaaaaggcttcaaatatattggcagttggagcattctaccgaccactgattccacgccgctttttcactttggcttcaattatttgaaccctgaaggtgatcgcaaaacagaagaattctgggtcgaccaaacctcacaacaagtggttaagcatcaagtcatgacgctgtaaaatgcgcaatcagcttataaatgggtcccttgggactgaacttttgctcatactccgtttcgatattcgattcattttcaggagaatgatgtaaatccaacgaaacataatcgaacttcatcgggaaattattcatggtgaccagggtgtattcgaataaaccgcgattatcagttttgaattcgatatccccgtcctgatccagcacatgattataagtcttcaaaaacagtggtgatgtcaaacgacgtttggcatgccgcttttttggccaaggatcggagaagttcaagaaaatctttttaatttcattttcataaaacaattcatcaagattggcaccatcagtcagaacaaactgcacgtttggcaacggatccgccataaacgaccgtagtgccgtggcaatgactgaagtctgcagttcaatgccaatatagttgatgtcggggttggctcgagcagtctcaataatgaaccggcccttaccaatcccaacctcaacgtttaagggttggactttggcaaaccggtcctgccatttacccaaccaattctttggatcggtcacaatatagtcgccgtggtttttgatatatttatcagcccacggcttttttcttacacgcatatcattctcctattattcaacgatttatctggttcgctcgcttcgagccaaacgtctgggtaaatacagatagacaaatgcccagatttcgagtgcttcgccgacaatcacgtcaatgatcgtgaccggcgtggccaaattaacggtcagaactgccaccgcaaaaacgacgccaaccgtagtcaacaagtacagcagaaccctttgaaaactcttcaattggtactgattggtaattggataaatgtggacgaaggcgttatccgagaaatgaaaataaaacggaatcatttggaacccaattaagtagacaaacagcaggctcaaaaagatgggtaacagctcgcctttgacgaataccagaaataaggttccgatcaccagcagacgaacgtatagcccactcatctcattgtcacggacaattccgtgagcgtagagatataagtaggtgttttttggaatcagcttgattcggttcaagaccccgtccacgtaacggcggcgtttgacagacccttgcagagttggcacatccgtaaacaaattaaagaattgatagacggtgtgcatccgactgttttcatcggtaatcatcgtcgtccagtcaagtgatcggctgacccaattccggcgggaaaaataactgacgaaaagcgcagccacagcaatgcccaacccaagccaatagttgatgtagatagacgatcccaatgcaatcactgggacaagcaatcgaaagatgagccgactggccaaccaggattgctgcaaatggtatttgcgggcaaagtctgtatttagccacgttattttcaagattaaaatggttgccaaaagcagatacaactccgtcgatgtggcgcgcatggtaacttgaacaaacggcatcaacaagatccaaaacagaacttgaattgcgacagcaatcgaaaaactataccgaaagccgcttcgaagatagttataaagttcagcttctttgggcaacaaaaaaacatagtctggggcttcaatcaaggtcgcaaacctgcccagctgaacgctaaccaacaaaataccgataatcacaattggtgcccaccacagaccggtgtgcagctgcttaagtgcattggaatagtagtatcccaacccaccaataacaaacaacaaagccaggacaaagtagtcgttaaaaaccaatctgagatagcgcatcatttcctttagatgcgtcgttaaacgctgcctgaataactgcttcatgaggcatcgccttcccttgccagagtcaggtaaatatcattgagagaatcgccggcatctgggaataatttccgcagctcttcaatcgttccttcggtgcgaacttgaccgtcatgaagtaaaacgaaccgatcacaataacgttgcgcggtatccagcacgtgagtcgacatcaaaatgctggctccctgttgctttctttcagagatcaggttcaataagtcgttaacggccagcggatccaagccaagaaacggctcgtcaataataaagagtttggcgttagtcaaaaaggcacagacaatcatcaccttttggcgcatcccttttgaaaagttgtccgggaaccagtctaatttattatccagccggaaaagtttgagcaggtcatgtgctcgtttccaagattcgtcttgatcaagtccataggccagcatggtcatttccaaatgttcctttagcgtcaattccttgtagacaattggctgctcgggaatataagcaatctgctctttatattgtttaacgtcatcgtttaagccgacgccgttgattttgattgagcctttaaatggcgttaataaaccgataatatgattgatggtcgttgacttgccggcaccgttcaagccgatcaacccaaccaactcgccatccttaacgtcaaaattgacgtcctttaacactggtacttgggaatagcccccaaccagattcgaaacttgtaaggtcattgtttacctccgtatcatgataaatgtacaaacaagattataccatacaaaattagcctttgagctgggtcaaaaacgcaataatggtataatatcattagtattcacagaaagaaggtagaaattttgaaagattgtattttttgtaaaatcgtaagaaatgagatccccagctacaccgtgtatgaggacgacattgtcaaagcattcctggatatttctcaagggactcctggacatacgctggtgattccaaagaagcacatcgccaatatctttgaatatgatgaagaattagccagtgaagtttttgccagaatcccaaagattgctcgggcagtcaaagcttcaaatcccgacatcaaaggcatgaacattttaaataataacggccaagtcgcttatcagtccgtctttcattcacacttccacctggttccccgatataccagtaacgacgactttaagatgatcttcaaggataactccaacaaatattcaccggaacagttaaaggcgattcaagaatccattgaacaacatatgggtgattaatcatgaaaaccgtttttaaaattgttggtgcaactgccgttgtcgccggagtttatttatacagccgaaaagaaactccccaagagttcgttgaacaagccaagtcgacatttaatgatcgaaagcaaaaggccgctgactggaaagctgcttatgatgactttaagaagttgatgaatgctttcacagcacagatgccggcccttgagaagaccattaacgacatctcacgggatgtggataaagcgatgttcaaaattcagccacggcttgacgaaatcaacaagtataccgacaaattaaagtaagtaaaatatgaatatttgtttaaattcttgaggtcattatataaacgacgcagattatgttattattatcgggaacgtttgctttgcagacgaatacttttaggaatggatgtgtttttgtatgaaaaaatggctaatcgttttagccggcattatgatgagttttacccttgcagcttgtggcagcaaaactgttgcaacaaccaatggtggtaagattactgaaagtgcttattacagcagtttgaagagtacttcaagcggtaaacaagtattgcagcaaatgatcttgaacaaggtcttggaaaagcaatacggcaaagatgttaaggactctcaagttaatagtgaattcgctaaatacaagaaacaatacggttcatcattcaactcagttctccaacaaaacggtatgactgcttcacaattgaaagattcaattcgttccaatctcttattgaagcaagccgttaaggacaacgtcaagattaccgacgcacaacttgaaactcaattcaagtcttaccaaccaaaagtaactgttaaccaaatcttggtttcaaagaaatcaactgctgaaaaagttatcagtgaacttaaagacggtaagagcttctcaagcttagctaaaaagtattcaactgatacagcaactaagaacaagggcggccgaatcgcagcattcgacaacaccaacacatcacttgatgccaacttcaagaaagctgccttcaagctgaagaacggtgaatataccaagacccctgttaagactcagtatggttaccaagtaatccaaatggtcaaccatccatcaaagggaacttggaagcaacacgaatctgaattaaaggatcaaatcgttaccagcaagatgtctgatagcaataccttacattcagttgtttctaaggttcttaagaagggtaaagttaccatccaagataaagacctgcaaaacgtcttatcagactacctttcaaccagctcatcagctaagaagtaatttttaaatcattcatacaaaaaaggattggacaattaattgtccaatcctttttgtatctcgtcaattataacaattccccttgcgtcggtttttgtttggggtcaattgaattctcaggtttgtagaatcgtcgattatccaatccaaagacccgatcactgaattggccgggttcaatattcttagtggcgctttgaatcatcataatcgtcgcatctaactcatccaaatgatgcagaatttctgcctccaatatcttcggccgttccggtgaaccatactccagtaatccgtggtgcgacagaatcatatgccgcaataaaatcagatcctgggatttgggatcaattcccaatttatcggccgcttcaacgatctcggcatccataatgctgagatgccctaacagattccctgctaaggtgtactctgtggcaattgggccggacagctcaatggttttaccgagatcatgtaaaatggcccctgcgtacaataatggggcattaatgccctcatactgattcacgatcgaatgggccagtttgagaattgaaatggtatgaaaagctaaccctccagcaaaatcatggtgattggattttgcggctggaaaggtataaaacgcgttggcgtgcttggaaatcaagctgcggacgattcgattatagattgcgttggtaatctcaaagatggtttggtcaatgtattcttccatctgatcgcgagacatccccgcccgtttgacaaaattaaccggatcgtggggctcactttggttggccagccgcattgccagaatcttgatttgaggagaattcatgtagttctcccgcttacctttcaacagaacgactttgcctgaaacaaactgctctacatctgttggcgaggcatcccagtatttgcctgagatttggccggatttatcttgaaaaaccaacgacagaaatggcttaccatttttagccacccgcttggaggcgtcttttaataaaacatacatctcaaattcttcatccaacttgatatccatcaattgttttgccataaaatcgcctcctaaagcgttttaagatctaagacgagcttggaatcagtatttgcattgagattagcggtgaagtaaagcacttgggtcttctcactcacctgttgaagcattgtcagagctgccgcttttcgacgctggtcaaagttcacaaagccatcgtcaatgataattggcattggatattgactgctgaagccaaccgccatcgaaaagatcagtgccaaataaagctgttccaacgtcccggttgacaattcgttgattggaaaggagacatcatcttttcgaacgacagaaatttcttttttaaaaataatctccttgtaggcatcattcgtcaaagtggcgaaatattgctttgccaatgccagtgtctttggcagtcgacccttgctggcaatgtccaacactgattggatccactgggaactgagcttcaaagccaggtacttctgaacattctcaacaatttcagtttgttgattggccagctcctgccgcaaatcgtagtattggccattcttgattaaaccggcaatttcagtctgaacccgggtcatttcccggctcaaatcattcagttgatcttgtaaggactgcactttttcggtagcttcacgaacgtcggtgttcaaggcatcttggtcaatattttctggaattgaaattttggttgccttaatttgactttcaagcgtggccttttgatccagttgcttggccagttcagcctgaaaggcaacacctttttgaaatgcttcgtcgttttcaacatgtcgatccttcaagaaggtttgtttttgctgggtcagttcgaccagcttggcctttgcggcagccagtgtcttcttctcctgagtgagtactgcttgttggtgctgataatcggtagacaactgctgccaatgagcaacggtcttgccgatggtttcaatggcggtcgaatgctttgtttgatcaaatttcagccaatcactggcaaattgccattggtcaaggtaatcctggtacttggcctgctgttcattgagtgctgttttttgctgttgataactctgttgcaggcgctgaatttctcgaagcgaactttgcatcggcagccatttggcttcatcaattccttgcagtccaaattgctgttgaacagctgtcaactctgttcgaatttgctcaagtttctgatcgatctcaactggatcttcatgacttgggcttggctgggactttgaactccctttggcactataccatccccaaacggcagcagcgaccgccagaatatatccaatccatccaaacgaactagagcctaataagaaccctaataccaccagagcggctgccacaccataccagattagcccaccattaccatgaggctgttcggcagactgggttttctttcgagttacctccgcccgtttctcttggagattctgttgctcccgcagcagttcgttcacccgagaaaaggtctggtcatcaaatgcttggggcagattcccctgtgcatttttcgcaattgaggcagactgggtctggacttgtcgttgaacgtcctgcagctgagaatcgcctaattcgatggccaaagcaacctttctggcgtctggcagctcttggtataaccgttcgatcgtgtcgctatgagcctcatagaaagtttgaaccggttttctggatgactggcgggccgcttcatcgacagctgtttgagcctttttaacatccgcgctttcagctgtcagtgacatgtttaatttattaagctcattgagatcagcactaccgaattgtggcttcacctgagatgaatcgaccgtgttgagatcgtttagcctgttaaccagcggcaagaccgtctgcagacggcgtttgttatccaactgctgattagcagtttttaagtcagcctggaggtcccttgatttcacctggtcctgcttcaattgaacctgcagatcctggtagtgtgggaagtggtccttggcagcgccaacctgatcttcgagttttttatattccgcaatctgaatattaatcttttttgtacgaccgcggggcgcatacatttttgccgactgcttatccaaattggcctggaggtccatccaatcgcctgccccggcgacaccaagtgattggattcgcagccgtaattcgtctcgacctattttgtagaaggccgtctgatcaacgctgccaaagtaaaacaattggtcataagcggtccggtcaattggcgcaatgagctgctggtagtcatcagcggtaagctcagtatcgttatccaaatcgtagaattttaccgtcccgccgtattttaaaccagttcggacaaccttatagttatgttgatcagctgaaaaaataatttcaccgccatatggggcactgcccttgggctggtactgaccgtggatggaatgctttttatcagtgaatccaaacaggatccctttgataaacgcgatgatggtactcttgccggcttcgttaggaccataaatcatctgaagtggatttttgatatcaattttttgatcaatccagcggccaaaaccataaatgttgagttgtttgattatcacttggatttatcctcctcagtatcttcatgaacgacattttcctgaagaattgccccggcttgatcaaagatctcctgtttggattcttcagatccgacttcgtccttgatgaaagttggctgcttattaaagtccttgagaatttgatcaaaaacttcgtcattcaaggttgccgccttggcttgattaaaataatcctggtcaatgctgctatagaccagactttttacttgtggcgcttcaattgaagtaatccagcagttgagctgctgccacttgtcggcattaatgtcctgcaggtcatccaagagatcaccattattaattttggccagtaagtcggcatcgatcgccgtttggctggccaattggatccgaatgaaatgtaatttgtcgtagtgcaggtcggcaactttttccaaaattgattcaacaatctggtctgcagagatttcatcaagagaaatggcgacccggtcccaaacgatcggtgcggttggcacaaatttggttcgaaggtgctgatcgtcactttgaaccagcaaatagcccttctcacccgattcattaatatggcggccttgggtgttcccagaataattgatggtttgctgctcatttaacgactggcgcttatgaatgtgccctaatgcccaatagtcataacctttttcctcaagttcagacagtgtgaacggtgcgtaattggcctccggagaattgagtgaacttaagcttccgtgtaacatgccaatattccaattcacatcactaaccgccgttgggtagtcttgaatcatgggttgggtaatccactgcttatcaaagctaaaaccgctgacggccactacttccccatcattcaaggtatactgcttggtttcaacctggttgccaaaaaccagtgtattcgctgggtagccaaatgaagccggatccgccgtagagtaatcatggttgccaaagctgataaaggcttcaattccatgttcgttcaatcgattaagctgagcgatcaggaacgcgtcggcggcgacgcttcgttcttctcggtcaaataagtcaccggccagcaaaacaaagtccacttgctgcgcaatcgcgttatcgataattctttgaaaggaatcaaaagttgattgatgaactttctcccagagttcactgggtaaaacatgacttttgagccccaagaacgggctgtcaagatgtaaatctgctgtgtgaataaatttcatgatagatcccttcttcaacttatgtataaaggaaaggccgaggcaaaagtgcacacactttttgtctcggccccttttgtcccgtgcttgatctgcttatgatttgtacaagtcgctgattggttttgtcacggtctcattaatatctgataataactggctcagtgccttttctttggtcattaatgcggaaattaattgactctcgcgcattttcccagcaatcgcctggatgttctgaatctcgtcttgggttggttgaacgccctgcatttgtttttgctgaagattctgttgagcatcttgaaaatcattgaataatttgtagtcatccaaactcttcttgagtgcgtcataggcagctttgatttccgtaaattcatcggatgcaatcaattcggcttgaagctggttggttgttgcggtcattttttcattcattaaatagggtcccctaacaattttatttacttaattctaacacattactgaaatggcttcctgccaaagttagtgtttgaaccagcttttggcatcatcaattaaatctttggctttttgttcgatttgattaccatattggttcgttttcttttgaatggtatcccaaagattgtcattactgctttcaccttgaacaatggattgggcatccttggtgttaaagctggaattcttggtatatggcaacatggtctgcatttcgtttttgaacagtggcccgacaccagtcccactcaagttttccaaatggtgggcctgactggtattatcaaatccttcccaagtcgccaccaccaaatctggcgtatagccaatgatccatttatcttttgtggcgtcagcagagccggtattatcggcttcggtacttccggtcttacccgcaacctgatacccatacggcttggcgtcagcaccggttccattgttaaataccccaagcatcatgctggtcatctgtttggcaaccgaactggacataatttgacggccttcctgcttggccgtgttatcaaccaccactttacccgtagaatcaacaatcttgcgaatgtaaaatggtttaacaatctttccgccgttggcaaaggccgtataggctccggccatttgttgaggcgagacgccgccggacattccgcccaaagcgagcgccaggttcttgtccttcttggtgaccggaatgttaaagtctttgactgattgataaccgcggttgacgccaatctgattcagcagccaaaccgccggtgcgttcatactttgcgctaaggcttcatacatcggcacttttccttgataaacattgttatagttcttcggtgtgtaatgattggtgccataagatttcttcttatcaaccagctccgaatcgaacttgtagccggcttcaagtgccggcgtgtagacagccagcggtttcattgtcgatccaggctggcgggtaatctgagtggcccggttgtaaccccgaaagacgtgcttaccacgaccaccgacaacggcagtcacgccaccagtggtcggtgaaacgccaattgatgctgcttgaacttcggtgccatcagccgcgttggccggaaacatagcattgttattaaagttgttctgcatcgcctgctgctgagcctggttcaaattggtgtaaatccgatagccacggttcatgatctcagattccgtcatcccatacttactgatggcttcatcaatgacggcatcaaagtaatatggatacttgtaaccgtcttttcgaacataggtatcccgcagtgtgattggcgttttcttgtagtaatttgcttgcgcctgggtcagcttattattttcaaccatcagctgtaagacgacgtttcgtcgccacttggcggcctttggatgatcaatcgggttaaaggcacttggtgatgtcagcatccccgccaagacggcagagtcaggcacagataaattgacagcattttcaccaaaatattttctggcagcatcctgaaccccccaaacgccgttaccaaagtaggcattgttcaggtacatggtcaggatttcgttcttcgagtatacattttcgacttgaattgagaggaataattctttcagttttcgagtcatcgtctgctcttgagacaggtaagcattcttgaccagttgttgggtcaaggtacttccaccaccactaatataattgcgatgaagcagcttgttcttaacaagtaaaaacattgcccgggcgattcccttgaacgagaaaccgtattcatgataaaagttacggtcttcggtggatagcacggcctttggaatgtttgccgagacttgatttaaatgaacataagtccccttttgagcgtataattcgccggcttttttattattaacgtcaaaaatttcagttgtcttcgagagcgaggattccaagttctggacgtgggcggttttggcaaggaacaccaaataggtgctggtcacaagtgaaatactcagaaaaatgaccacaagccacttaaccaagtggaatcttcgacaaaatcggttgaaacgtttcaaaaaggtcccgaccgattttctaaatgagttggtagaattcttattcatgcgatactccttttgtgaatacctcaatattgtatcatatctgaaaagtggcgaaattcagggtggaaaaatttaacgaggatttaaaaaagagtgcccgccacaagctattgatcaatctgaaatttttcgaaataaaaagaccccctacctggttggtagagagccttggtttcaaatacaattagattacattgcgtccggtgctttgacgcccaataagttcaatgattctttgagaacaattgaaaccgccttgaccagtgacaaacgagctgccaattgatcgtcttccaccaagatctttgagtgcgcataatacttgttaaaggatttagcaagtctcaaggcatacttggcaatttctgatggctcaaagtccttgcaggcactcttaacgacgtctgggaagtccttcaaagcggtgaccgtttcccaagccgctggatcatcaagctgcttgttggcaccgtggagatcaatgtccccggcttttctcaaaatactttcggcacgggcgtgtgaatattgaacgtaaggaccggtttcgccttcaaagcgaagttggtcttcaagcacaaagtcaatgttgttagttcgctcattcttcaaatcaccgaagataattgcgccaaccccgacttctttggcaacttcatccttgttaggcaaatcagggttcttcgcttcgatttgcttcttggccaagtcaatcgcatcatccagcacttcatccaacaagatgatccggccggaacgagttgacagtttcttaccattaaccgtaatcagaccaaatggaatatgatgcaggttttcggcagatggtaagcccatttcaagtaaaacggccttcaactgctggaagtaataagtctgttcggcacccacaacgtataagttcatggctggtttgtaagttcgatcacggtaaatggcagtggcgatatcacgggtaatatacaatgtggcgccatcactcttcaagataagggctggattcaaattatatttatcgagcttaacgacttgagcaccctgggattctacgagcagacccttgtctttgagaatttgaattccttcgtccatcttatcgttatagaaggcttcaccgttgtaggtatcaaaagtcacgcctaatttttcgtagatcttgttaaatgattccagggaaactttacggaaccacttccacagaaagacttcttcttcattgccgtcttccagcttcttgaaagtttcacgggcttcatcatccaattcaggatgttctttatcttccttatggaacttaacgtaatacttcaccaggttgttgatgggatctttcttgacgtcttcttcgttaccccacttcttgtaggcaacgatcagcttaccaaattgggttccccagtcacctaaatggttatctttgattggatgatagccgtttttaaccaataacttggcaattgagttcccgatcacagttgaacgcaggtgtcccattgaaattggcttggcaatgttaggtgatgacatgtcgattgggacattgccacccttaccactgtcgttttgaccataggctgagccttcttccaaaacctcattcaaaatttcattactgaagtttcctttatccaagaagaagttcagataggcgccctttgcctcaaccttctcataagaggattgatcgattttctcaaccaattcttgcgcaatggcgtttggtgccttatggaaaactttagccaatgagaatgctggaaatgccaaatcacccattgctaaggtcttaggcttttcgagcttttcataaacctcagctgacgacaattcgtcatttaaaacacttaaaattgagttcgtaacctgtgctttgtagtccattaatgttccctccatctataaatatacaaaaaaactcttacaaaaataattgtaagagacgagtaaacccgcggtaccactctatttgataaaaatatccgctcaaagtattaaattgatattctaaaaagcgcgcttcgctgactcaatttttcggctcccaccatcccgaaatcgctgacaattcagtgaccagctactgttcttttattgttgaatatttataacgttcaatgtgtataataacttgttgacccggtatatgtcaacatttatcaccacaccggagtgctgagacaaccaacactaagcgggtaacgggaatcggacccgcgacgcaagcttgggaagcttgtgttttaccactaaactatacccgcataacaaaaacaattatatcattttaaattatctttgtcataaagatttgaaatctctaaagaattttggaaaagattgctttttcgtcccaaaatacagatacttaacttaagaggtgatttgaatgtggatcatattgaactacagctgttgggcaattctattcgtcaattttatctggggattgacccgatccatgaaaaagcacgtcatcgattcgatgatgatcgcccgcgtcttctactggctcatcatgattagccaagtcgtcatttcacttcgttcatttcaccgtcatccactgctggttatcattggtgcagtggtgacgctggcagtgattgcattaaccgaaaccgcttatggccgaaagcaagacgtcaactacagccccaaactgctgtggttattgatgctcgccacgctaatcgccgtatgcctacaaactttggtcaactattaagttagttggctatttattttgcccgatttgcctcggccaactcaatacacttatcagccaaaaccgtctgggcgtcaatcactggataatcgtgattacccgcccgctgctgggcaactgacagttcagtacagcctaaaataacgatgtcacattttaacgattcaaccatttgagaaagaatcaggtgatacaatccctcatcgacctcgtttttggccttgatatcatcatagattaaggtcatcgtctgatcagcaatcttgtcggttggcttaactaattcatagccggcattaataatttcatgatcataaatttgatcatgtaaggtgccttctgtggcgattaaaccgacccgtttggcattcggcgcgtaattcttaatggctgcaacggtttcctttggcatatgcaagatcggcacatccgtgagtttctggagctcatcatagaagtaatgagcagtattgcaaggaatcgcaaaaaaatcgggatgtagggcactctgctgcttgacgtcttctgccagcggaatcaatgggttgggctttgagtgatccaaaatgtagtctgtccgatcgggaacggtcgaatgattgaccaaaatatagttcagatagtcctgatccttggttgcctgagtccgctcatttaaaatatgaatgaaggtttcagttgcttcggtgcccataccaccaataattgtaaagaaatttttcaactaaatcagtcccttatttttcgacaaagtatgtcttaaagctcttggcataattgtgcatcatccacttatataatgcaaaacgtttgatatttttgtccttggcgtaccagaaagtgtcgccataacggccttcgttgatcatttccatggcttgctttttggcagcattgtctttggcgtacttttcaaagatctttggcgtgacaccaagccacaggaaatattggcgtgggtccttgttggcatacaaggtcgactggtccttcagtgaatcgaagacgtaatcttgaatcacccaatcagctaaatgatggccgttcaaggttacgaagaaactgctccggccagtccgcaaattgatttcaaacaatttgtaagaattgtctcggtggtcaaatttcaaatcaaaattggcataaccgtggaaattaattttttcgaggaacgcctgaactttgttgtagatttcctgattaaattcaggaatgattgcgacataattcccaatcgctgccggcgctggatcttccagtagtggatgacccagacacatcaatttaacttgatgattcttatcgacatagacgtttaaagtgcgcatattactgtcgtcaccagggatgaagtcttggagaatgaagtcggatgtataaccgttatcataactcttggcaacaatctcctgaaattctgcttcactcttaatgataaacgcctttttgcgtccttcaaagtgaatatcaagccactcaacactattggccggcttcagcgcaaccggatagccaaatggctgttcaatcggctcgcccgaagcatacatggctttggaaatgatcttcgttttcgggtatggcaggtcgtattgatcacacatcttgtagaagttttccttgtcgttgagcttcttaagtaaatcatagtcaatgtatggacaaatgaagacatcttctaattctgctttatgtttggcaatgagttccgcatagccatccccacaaccaattaaaatcaccggttcttgatgattggcataacgtttcttaagctgcttcatcgtatcaatccagactggatcctcactaaaaccgggaatcagttccaaatcaacaattttggtgaagcgcgtcggtgccaactgggtttgggcaaatgctttgaccggcttgccataaatttcgtataaacttctggccatcccgtaggcgttaaagtcactgcctaacagaacgggcgtaaaatcaagctgcttatttttcattactagagtcctttcacaagatttttaacaattgccgcatcgccttcatacggaacgtttttgccattaatcttttgatattgatcatgacctttaccggcaaccactaccaagtcacccttctgactttcggaaacggccttggtaatggcttgcttgcggtcggggatgtaggttgtagccacttttgaggtatcgatatgagcagcaatttctttggcgatttgttgcggatcctcggttgccgggtcatcggtcgttaaataagcctgatcggcagcctcgttgattgctttgccaaggccctcgcgacgatcaattcccttatcacccgtgctgccggtgataaccgtcactttaccgttaggagcctgttttttcaagaaatcgagaacggaatgtaaactgccatagttgtgggcatagtcaacgtaaaccgttccgtgatcatgggtctgataaatttccattcgcccgggaaccgtggtattggccagaccataagcgatctcggtcggtttggcccccatcaaggcgctggtaatcgcagcggcaactgcattgccttcgttataatctccaggaattccaatccggtatacaccgtcaatgttcaattgcttcgccttggcggttcgggcagtcacttggatttgattttccgtcagcgaatcctttaacgatcgatactcgacatctactggaaattcagtttcctgattctgcccagcccgtccataaataaagatattttcaggttgggtggttgctttagccgcgtaaaagatgtcggttaaatgtgtcccgtcagcgttaagcacacaaacgtcggaattaaccaacaactgttctttgcagtgcaaatagtcagcaaaagttgggtgctcgttgcgaccaatatggtcaggtgaaatgttgagaaaaaccccaacatcgtaatgcagaccataaacccgattcttcttgtaggcttgagatgaaacttccatcactaaatgactcatgccattatcagcggcttttcgcatcatggtaaacaaatccaacgattcaggagtcgttaaatttgatttaacaacatcttcgggctttaatccgacaaccgtattgatggttgaggataaagcaacctttcgctgataagtttgatccagaattgctttggtaaagtaagcagatgtcgttttcccctttgtcccagtgtaggcaatcgttggcaattgatcttgtggaaacccaaaaaatgccgcacttacgagcgacattgctttttggatattcttaacaataatgcctggaatgccggcattttggtatgtcttttcggacatgtacgcggtggcgccattctgtctggcatcatccagatacgcagatttgaagttccccttacagaagaacaaacagttgtcagtgaccgatttagagttatatgaaatctggtcaaagggatcacttgagctgctcaattgactttcaagcaataaattatgttctttgagtaaaactaaaacctcagcaacagtaatttgtgccaatatgtgcaccttccattctttgcatatttctaaatctgggtacgatgaaccaagctgaccgtgttctcagttgtatcttctgggaagtaaacttgataccagaggataaaggtatagatggtgaaaatcttctgcatgttggacttaccttcagcatgctccttcaacagacgatccaattcgttggtattgaagaactttttacctgtatcagaatggaaagcattcacaattcgttcgtgatacttaggatcattaatccagctggcaattggagatgggaatccgagcttctctttaagagcagtcttcttaggcatttcccgttctgctgaagttctcaacgcaattttggtctcatccggtgtaattcgtgtcttgactggcatggtttcagcaaatttggcaacttccttatcaacgaatggcacccgaacttccaatgaattacacatactcatccggtctgccttgtggagaatgtcgaatggcagccaagtgttaatatcaaagtactccatttgggtcatttcgtctttgcccttgacatcatcaaagatgtgcttggtgtaggcgcctgaatctgtgttaattgaaggatcttttaacacgcgattgcggtcgtcgtaattaaagacgtagttcacacgatagtaccgttcactcaacggctgggcaccacgaaccaagaagcgtttaccgtggaaacgaggcagccgtttggcaactgcagccagccccttacgaaccggctttggcacatacttctgataacgatcgaatgggatagcttccagataggtgttgtagccaccaaagaattcgtcggccccttcaccggacaaagcaaccttgacgtgcttggaagtgtcctttgataaataatacagctgaatggccgctggattagaaagcggctcatccatgtagtacatcatagttggcaggaaattgaagtaatcatcgccattcatgtagattggcgtattcttttggttaatggtcttggcaaactcagtcgaccaagccaactcactatatttggagtggtggaaaccaatcgagaaggactggatcggctttaatttggcagcttcgtttaatacgtagcttgaatcaattccactggacagaaaactaccaacttcgacatcggcaatcatgtgggccttaacagaatcatcaatcaacttaccaattttgtcggcgtctccttcaatggtttggctattgtcaatatgatcgtagttgaatttgtagtaacgatgggtttcagttttgccgtttttatgaaggaaatattggcctggcaaaagtttgtagacgtgcttgaacatggtttctctggaaggaataaattcaaagctcaagtgaattggcagtaagcgcaaattcagttcctttttgaagttgggatgctccagaaatgctttgatttcagatccccaaaggaacgtatcaccatcatcgtaatagtacagtggcttaattccgaagtgatcccgggcaccgaagacctcattgttcttcttatcataaatcacaaatgcaaacatgccgcgaagcttgtctaataaggctgggccccattcttcgtagccgtataccaaaacttctgaatcaacatcagtcttgaaaacatatcccaaatcgcgaagttcttcacgaatttctttataattgtaaatttcaccattaaaagtcagtactttagtttggtcagcgttgaacattggctgacggccatgtgctaaatcaatgattgaaagtcgacgaaatcccattgaaacattgtcgtcggagaaataagcttcgtcatcggggccacgatgcttgatccgatcagccatgctgttaatggtaccttctggaacatctttttggttaacgtaaccaacaaatccgcacatattttatacccctttatcaaatcttcttggttagtctgaaattaataacgttttatattttatcagattacatagattgctaccagtagtataaacctttcttaaagaacggcttgcctaaaggaaattaaaacactttcgaatttcattttaccattcttttaagttatactttagatagagtatcaaattgtttttgaagggagagatacaaatggacgagatcgtatttttcaacccgggagattctatcggcaacttccatgatcacaatgaagctgtcaaaaccgctcaaatttacaaggaaaaagaacacaacaaaaaggttttagttgttcatggtgtcgacaacaagaacttcgatatttttatggccgacgacatcattagtcacgacaatgaaagaaacgcgattcaaaagccttataagatttctgatcggatttagtaattatgtaaatttcatcagaaaaagggattcaaaattgcttccaacaattttgaatcccttttagtttatagataaatttgccgcaagaactcgcactacgttccagcccaaatttgctggagaacggcattttatctaattttgctgccatgaacgttttcgtatcaagcaacaagataagtttttgtagtttcaacctttagtaaataaataaaatatttggttacttcttgcgtagagtaaccttttttatattaccgctattttattagagaataaatacttaaaataaaaaatcacgtatactgaaataatttccaggttatgtgatctgtatatttcaattattgacaggcaaatttttaattaccgattggccaaaaaagcagatataaaaaaattaagtctcacattgaccaactagtcattgacttattggtcaacggagcttatactctgcttattaattagttgaagctaagtacccatggactttagccgcaattagttcactaaaattaatcgtgatttagaactcacaagggggcagtgttatgtctaaaacagtactttcaattaatcatttacaaaaaaagtttggaaaattcgaagcattaaaagatattacttttaacgtcaacaaaggagaagtttttggttttatcggaccaaacggagctggcaaatcaactaccatccggacattactcgggattctccgctcatctggcggttcagcgaccatttttggtaaggatgtttggcaggattccgtcagcattcatgaacgcctcgcatatgtgccaggcgatgtttacctatggcccaacttaaccggtggcgaaattatcgacctgtttttgaaactcaatcatcaaaaacataccggtcacacggatgagttaatcaaagaattcgaattggatccctcaaaaaaggcccggacttattccaaaggaaaccgacagaaagtggccttgatcgccgcattttctaccgatgctgacttatacatctttgatgagccaacatccgggcttgatccattgaacgaagaaatctttcaaaaacacgtacttgctctaaaaaacaacggcaaaagcattttattatccagccatattttatccgaagttgaacgtatgtgtgaccgcattggaattatccgcgagggtcgcatcattgaaacgggtacgctaaccgaaatgcggcatctcacccgcacactagtgactgtgcaaacacgcaagccactgccggatctttcaactagcgaaggagttcatagctttaaaaattctgataatgtagcaaacaaagtcagtttcagcatggattctgataaaatggctcaacttatgctgaccctagcgccattagaaattattggtctacaaagtacaccaccaactcttgaagatctcttcttacgttactaccaaaaagatgagcaaggagatgggcaaaatgaagcgtaataattatcaacaaagtgggtttttaacccgttttaatttgcgccgggattggtttttaattctcatctggctactcatcttgggtggtctaatggcatctgtagcctttaaatttaacgatttatatggcacacctacctcgatcgccagcatcgtgagcaccttaaaaatgccggcaatggtttccttatttggcgcatttgttgccaaaccgccctacaccacagccgatgtgtttgcgagtgaaatggttgtttttatggccctatttatggcagtgatgaacatctttttcgcggttcgaaatacacggggagaagaaagtaatggcatgttagaattgattcgttcccatgcggttggcaaacaaagtcccttattagcagcgactctcgagcttttcttgattaatctatttgttggccttgtttactttggtgggttacaagtttctggtatgcacggcacctcaatagaaggaaacttattaattggtcttggcctggctactagtggcttcatgtttggaagtaccgcccttttaatggcgcaaattagcgataatccccgtggcgccaccatgctaagttacctatttcttggtgtcacctacttgattcgaatggtaacggatgtggaaaacgctgatttgacgtggtggtcaccctttggctgggtcgaaaaaatgtccatttatcatgaaaataattggttgcccgtcatcttttcgttagtgttgactatcgtcttactttttctaactttttatgcaagtcgtcaccgagatgtcgacgctggcttaattgcgacgcgtggtggacgtaaacgagcaaccgtattactctctggaccattcagtttagttttacggcttgatcgtttgagcttgattgtttggatcatcagtcttgccattttgggaatttcctatggctcaattttcggtacagttggtgatcttttgaaaacaaatccattaatgggcagtttattaggtcaatcagctttaaacgctgccggacgcatgattgccctaaaatttgccgcgctgttaatgatcgtttttgccgtattagcgaccgttcctagtgtgcaaacgctcttgagaattaatggcgacgaacgtaaaggctggttggaacaacttcatgccaaagccgtttcacgcgccaaaatttttagtagttatgctgcagttgcctttattatcggtactttgtctttactggcagccgtgagtggcatttggttggcaaacaccacggttatggatgaccccttatcgttcgctcggttatgccgcggctttctcggttacctacctgcactgtatgttatattaggaattagcgttttaattattggctggttcccacgactacagaccataatctgggcgttaccagtatacggattgattagtttatactttggcaacttaatgaacatccctgactgggcacaaaaaataactccttatggctggatcaacgatgtgccagttaaatcagttgattggccacagtttacccttatgatggtcttggcagttatcctgttcatcgttggttttattggttatcgacaccgtgatctgattgaaaattaattatcgaaaggagtgctcacttcaatgaccgaaaaaaaaactaatattcccatggatcctgaaaaagtgagccgcatcatggccacctcattaactgagtttgctcatcgaggctatcgtggggcaaaaacagaagacattgcacaaaaagcagtagtttccaagggtatcatcttccgctattataaaaacaaagcgcatctttatatggcgacactcaagtttgccacagatcgcattgaatccgttgctgattacagtgtttggcatgatgcacaggatcttgatgctatgattgttaatgcgacaaaatataaaattcagcttcaattgcaatatcctgaagaatttaaattattgttagatgcctatgcggaagcaagtgacgctccttccgctctgaaacatgaaattgctgaattttataacaatcaaactagtgccaatatggccaacatgattgacccgattttgaatcgactcccaattcgcaataatgttagccgcaaaaccattcaaggcttgatgttaggcgttttagatcaggtgggggccgaaacaaaaacactaatgcaaaagaagccagatgccgatctcactgattttgacgacattattgaaaatgtccgtggttatattgatgttttggaacatggttttttaaaaaaagagtaacaacaggcagagaaaaaattttctctgcctttttgataccaattttgtctttaaatgtttaaacactctgatttttaatgtttttctaaataatactggcaaaacactattaaggactttaactataccaaaaaaatagtacaattctagttgaataaaggaatttttccttttttctaatttttaagctttaacacttatccattatatcgaccatttcttaaattagaggtaattgcttataggctctatctgaataatgtaagtcaaattgttacaaatatatgaaattattaaattagtttcgatgtttacgcttttttatggtatcatttaattcgcgtctcttttagtgtaacttagtatgttaaaaacaaatattttttggaggaattgcaaaatgttttattacgattatgatcaattaaacttttcacgccgcaaattggactcaaaaaaatcgaattatttactccgtttttcttttttagaatatagcttaattttcaattttgaaaaacgagaaccaggtcgcgcagaacgtgaactaaactcattttttgaacatcatagtgaactaatcaaggaagctagtcatgaagacttgcatcggagcttagttaatgtcgttggtgactttgccatgactggacttgccaatcatttcaatgcaaccaatttcgtacaactccgtgaagcttatttagactggctgaccgatgaaaaaccagaaaatccagaagcttttcgcaaaattttgggtttgatttataaagatttctttgctttgcaaacacctgaagatcaaattacttctacaaatacggtgcctaagcaagtttaccaaatcacctattacgtgaatatgcatttgtatgacaagatgcagccgattcgaattgctgaatatttaaatctttcttatcagtatgtttcacgactttttacccatacaatgggcttatccattcagagttatatcgataaacaacgtgttgatgaatccaaaaaattacttctgcataccgatttaccgttaaatgaaatttctcggatgttgaattattatgattcaagcaattacattaaacattttaagaaattctcagatacgacaccaaagcagtatcgtctgcataatcaacgtaaacgactccaaatcaagcaagacgctttagctgaaacggctcgaccatattaaagttaagctagaaaaataatcccagttatgttctaagtgtgaacatagctgggattatttatttgcacctactaaaggttaaaactacaaaaacttattttgttgcttgatacgaaaacgtgcatggcagcaaaattagataaaatgccgtcttccagcaaatttgggctggaacgtagtgcgagttcttgcggccgagcttgccacaagaatagacatcgacaggagcaagaaagattttcggaacgaaaatcatcattactaggcggaataatgggcacgacctagagccacaaaccacgtcttcaagctcggcctttatctaagcaaaacccgctaagataaacgacactactgagcccatttgcttccagactaagtttaatctttgcaagcaacacactgatataataattttaatatcggtgttgctgcgcattattaaaccactacttttgaaccaagtcgtttaatactagttattgaagtgattttgatattttcaacctttagttacacctatttaaaaaatcatttctgattattgacgtcgtttcttcaaacgccgaatttaaaattgaagtgcaacacctgtaaactatacaaataggccatggagacctaaacttgaagcgtcaaaacccaagaaaggaagtctccatgacccaaaccaagaatagcactactttacattaccaacaactaaaacctgaagaacgaggcattattcaagcatcgcttacccaaaagctctcactacgtcaaattgctaaacggttgcaccgcagtcccagtaccatcagccgtgaagttaaacgcggaactgttcaacaacgaaacacggattacttattctttaaagcttattatgcgaatgctggtcaggcaatctatgaaaagcatcgagctaactgccatgcagtaagtttattaaaaacctgccgaagcttctttatgcaactaacggatgctttaaagcatcacccaagggttgatagtatcgatacctttgtccatcgatttaagagcgctcatccgcaggacgcgtgctcctcagtgtcaactgtttatcggtacattgatcaaggacttctgaagttacgtaatagtgatcttcctaagaaattgagaagacgtgttaaaggaactcattttcataaacgtcacaataagaaaatcctaggaacctccattgaaaagcgaccagacattgttcaacaacgaactaaatttggccactggggggtgatctagtcaaaggcaagcgtgtaccttcagaaccagctctcatgactttaacggaacgcgttacccggtttgaactgatcattaaaattcctaactatcatgcccaaacttgtttggatgagttacaagcggtaattaatgaacgtggtacctcgcagttcaagtccatcacctttgataatggcagtgaattttctttactagatcaggtcaagggtactcaaatctatttcgcacatccttattcgccttgggaacgtggttctaatgaaaatgccaatggtcaaattcgggaatacattcccaagggtgagtcgcttaagaattatacagaaaatcaaattcaacaaattcaagatgccttaaataacaggattcgtaagtcgattcactatctcagtgctgaagcttattatcagcaactaactgctgcctaagtttggattcctataccaattccctgtttatctagttagtgttgcacttgatttgacaattggggtaatcttttaggctaataatttttgaattatattcctgatttttttaatttttctaaacaaaaagagcccattaaggctccttcaaaattcgttgtaaaattccttctattaaatcattcatcaattgttcaaaatcaccaactggtaattcatcctgatgattatcaatcaccatcacggcttcaaataactgccgcacgcgatcaatcgtcatatcagttttcatcacatcacgtttttgccaccgctcaatcaattgcgacaacgtactatacaaataatcttcttgtgtggccgggtcgtccgcaaccaactgtttaagtttaggattcacataccgtgcctgcaaaatcaaactatttgttgccttttgcatcaattctttcattattttaggcaacaatacatggggatcttcagtcagatcgttgtccgccaacacggcctgtttaattcgttcgttttccgtttgataaacttcgagaaaaatttcttcttttgaattgtaaaaacggtaaaaagttccgactgcgactccagctcgttgcgtaattttaacaatgttagtttttttgaaacccaattcttgaaaaatctcctgagcggcgtcaaaaagtctttgttgtttttcctgcactggtcatccctcatttcatttcttaccaactcattttaatacttattcactagccgccagcgcatccaacatctcaatccctttcaacttgtaatgcgtcaacacgccaataattaaactaaacagtcccgtaatcagcgcagaccaaatgtaacccggataatggatcaccatcggaaacaagatactgcccgtttgtgctttgaccatgatgaattgatgtaagaaaacgccaatgccccagcctgcaacaatgccaacgacagtaaagatcacattttcccacgcaacataggctgtgacttcgcggtcgtaaaagccaagcactttaatggttgccaattcacgaatccgttccgaaatattaatgttggttaagttatacaaaaccactagtgccagtgccccagacatgacgatcatgatcaagacaactgatcctagcccaccagtgcttaattcacctgctgcatactgcggaaaactaacatttaaaacgccggtttgttttaataacttgcgactcagtttttcacgttgcgccttcttgacttgcgtcgttttgaccaaccgtgaagtggcatgataagttttgttggttaatttatgataataggttggcgtggtgtaaagccaatgaccagcataatttttaatcacaccagtaactttagcccgcacttttttaccactaatttggagaataatcgtgctgccagcctcggcattcatgtcggttgccaatttttctgacaaaatgacgcccttattagttaactttatttttttactgccattaactgattttaaactcacatatttttcaaaatttgtagtggcttttggcaccaccattgagaccgtgtcgttggcagttccgtgggttggccgtgccgtcactgatttaatcaaagctgatttttgtgccgaaatttgacccgcatgaatctggcgagttgccttgtccatcgtcacaatggcttgaaaatgttgcacattctcgtattgagcaggaattaaatcatcaaccgaattttggatgccaaaaccggtcaaaatcaaacccgtacatcccgcaatgccgacaatcgtcatcagcattcggcccttataacggaacaaattccggtagctcactttttgattaaaacttagtcgtttccaaaggggcttaatccgctccattaaaatccgttttccggctttaggagcccgttcgcgcattaaattcgtaggaacttcacgtaaattgatcgtcagaacaatcaatgcgctgcccaaagtggccaccagtccagcgaccattgtttgtgctaaatacgcccatggaatgacaccaacgaaatcgctcaagttgttatttgataacaaactgaatacgaattgtggcaaagtcaacatccctaacgcgccacctaaaccagctccgagaataccggccaataacgtgtaaacaatgtatttcatggcaatttcgtgttttgtatagcctaaagctcgcatcaaaccaacttcacgacgatttgtttcgaccatccgcgaaactgttgtaaacgtgattaagattgcaataaataggaagaaacccggaaagatgatcgcaatggccgcgatactatgagattcatcaaagtaatcttgataccccggattggtgctgcgatcattatacaaatatgtgggtttggcaattgccttaaccttggcctcagcttttttgaccttagcctttgctgcaatcagctcttttttggccgcttttgtctttgccgtttgataagctgctggcacctttgctaactgtttttcttctttggtaattttggcggattgcttatctaatttattttgcgcagtcgtttgtaattgcttttgtcgagcactcggacgatttcgcattgtgtgcttcaatttcgttttttggcggtcgatatagctattgtattggtcagttcccgctgcgtaatgcttcggatttctaaactgcaccgcaatgagcgcatattctttttgtttaaagaccgctttggggacataggcaaaataatttaccgtcccactgcctaaattagttgtgcctcgatccgtactactgacatattgcggcgaattcacaaagccaacgactttaaacgtgcgccgttttaaactggcacttttaggcaatcgatacgtgtcgccaattttatagccgttttgcttagcttttttatcaagcacaatttggttgtttttagttggcaatttgccacttactaacttcaatcgatcgagtttactgccgttttgatagccgtaaacgctaacgatttggttacgccttttctgtaatgtcgtcatatgaaccggcatcgcttgtttaacttgtttgttttgcttaattgaagttaaatcgctgttcgtcagccccatcgttgaggtaactttcacatcacttaatttttgcttttcaaaataatggcttgccgtttgattcagatcaggacccacacttcgaattccgacgtacagtagagaacccagtaaaataatcagcacaatcgacacaaagcgacccactgagtcactgatttcccgcatggttgacttaaaataagttcgattcatcgtgtgcacctaccattcaatctgttcaacaggggttggctgtttattgatatcaatcccttggacttgggcatcctttaaatgaatcactttgtctgccatcggggcaatcatcgaattatgcgtcacaattaaaacagttcggttggtttttcgagccgtatcttgcagtaactgtaaaatttgttttccggtatgataatccaaagctccggtgggctcatcacataaaagcaacttgggatttttggccaaagctcgcgcaatcgcgacccgttgttgttcgccaccagaaagttgtgcaggaaaattatccattcgcttttcaagaccaacatgtttgagggtttcttccacatccaaggcatcatctgccacctggctggccaattctacgttttcacgggcggtcaaattaggaattaaattgtaaaactgaaacacaaaccctaccattgtgcggcgataagaagttaattgacgttcattataggtcgcaatatcttggccatcaattaaaatactaccctcagttggatgatccatgccacccaacatgttgaggacagttgattttccagctcccgattcgcccaaaataataaccagttcaccttcatcaatttcaaagttcactttattattggcaacgatggtattgctttcaattgtgtaacgctttgtttcgtcttttaatgtgataaatgccattttttcgtcctctcaaatctcgattactgttacttgaattatagcatttaaaaagttgctacttcacgtttaatattaacgggaggtgatctgaatactgtaaaaaacttgaatctccaaatgtaatattaaacgttgatttttcgggaaggtacgcataatcaatatagtatggtttctctggtttccgatataaataaaaagttgcttgtttttcttgcccaaaaagatcaccggtttgcatatgataggcgcttcctaagcctacctttgaaacaagtttattaaagtcagaatgggttcgatagccatgttttctgtcccacataacattgctgttaaaatcgccaataatatatctattttttagtttttgaatattgaaactggaatacaaatacaaatcttcaatataattatccttcgtccaaactcctaaaaaatgatgttttaaaaaattaaatggtaaataataacgcatgcgattatcattccaatgcacaggattgatagtagccactggcgaaaatacaagtaatccctttttatcacctttaaagcacttgtaagcactgcttttaacatagtttaaatactcaggtctgataattttctccggattttcacactcttcaattatgtataaatctgcattaagcttctgaatatattgaaacttatttcgaaacgcaccattacaattccaactaacaattttcaaatatctcactagctttctacttgcttgtcttcattatactttttgtacacgagactatgctatttaaaacttaaaaaagcaccagataaccttttcagtaatccaatgcttctagcaaaaatttaattaaccgaattaaagtgttgttccgccttcaatggaaattcagttggctctttagcattcaacaattcaggtgtcatcaccacacgcgtaatcgtttggtcgtcatatggttgcatgtaataagcaccctcgtctaaactcatgtagccgcgatactgagaatagtcacaaccaccttcattatcagctttcacgcccttaggaatctccacactgttcaaaatgtgcgataaggcattaattgaaccaggcactgtctttgccttatcagtattttgacgaataaatgcagctcgcacgaatcgggaaactgaggtgtagtctcctggtaaaccaagtgctccactacctaaaccataagcctccgattcaaactcgccatacttctttgagctatgagaagttggctttaattgcacataattatttaaattctttagatgccattggaaatcaggactattggtcatgactttaactggatcatccattactttcatcccgttttcgtcttgttccaaaacgacacaagcacccgttttattagccacaatccagtgaagtggcacgataatcttaaacaaatcattcgcaattgcgacaatattcagatcagcaattttagcttttaaatcggcaacattcgtgacattacctaaaatccagttgatgacctcatgaggcgcaacattcgttttacctgaaactgcttggtcagcaaatttagctaagccgtcaaagtaaagcgttgcggcacctacaccggcttcgttaaccccgtcgactaaaatataaccattcaaatctcgaccagcaccagtaaaacctaattttgtgtcaaaacctttttcatcagcatcacttttaaaatgaaaattacgcggaatcacaacaggacggccacccaattcgaacgaaaaatccatcgttcgcgccaaaaaccaattaccctttgcattttggtacattacacttgtacacatatgtgtgtcacatcctatcgtttgatttgtttctaacttttagtacatagaattagtatattctgattgaaaagccaattcaaacgaaatttaggcgaaatatctgtaattgtgcggttaaattggcacatttgtggtacaattcacattaaggtgccaaatcttatcagacaattgtctgatgcgtatgaaaatacgccgcacatttattgtgcttgtagcaaccatcccgactactatgatggttgcttttttgtgcactaagtagctcaaacgctaggctaaatcctgaattaatctaggtttaaagttgttaccctatactgattcgtgaattcccttgttgcctattgataatttgttataattaaacacacttaaattaaaaattcataaaaataataattacttagttaagagatgaattactttgacccaacacgactggctattatcgcctctttttaccggcatttttgtaaccttagggattatcctgttctttcaattgttggcgcgcactttaatgtcccgctcaaccaaaaagggagctcctattaattatttggtgggtagtcttgccgttttaagcacggtttacttttccgcacttgccatttattttgaaattgcggctgctcaacaggatagtgacattgctttcattgatttccgtttacttttgttatcctacgtcattattttcttaggtcgacgcacaagtttcatcgtcattttgtgcagttttattacccgcttcttattctggggtagtacaacaggcacatttatttttattgcattttcagtgtttatgtatttaatttttgcacttaatttgcacttaatccgccgccaccacagtagtcagttagtgttagtcaactgcttgaacattattgtaggtgttttttggttacttcttcattacattcgtttagattacttaggtgacattccgctatcgcaagttgtctattattggattgcgtttggtgttatgaacttcttcctatattacggattaactcaattaaacactgaaaatgattatttaaacacattaacgcaccaagctactattgatccgttgacccaattgaaaaattatgctgtcttcaaaactgatttcactaaaaaatttggtgagtttcatagctccaagaaaccactcgcgatgatcgctttagacattgattatttcaaacgggttaatgatcaatacggtcatttagcgggtaataagattttaattggtgtaggtaaactattaattggagcggttcacgatcttcctgatgcgcactgttatcgcgttggtggcgaagaatttaatgtcttactacccaacatcagtcttgaacaagctagccaatttagccatgacttgcaagctaaaatccggcaggccacattccaaatctcggaaaatcaaaatataaaaattacagtttcaatgggtgtatccactcttcatgccagcgataaaactcaaaatttattttacgaacgaactgatcaaatgttataccactctaaaggtgagggccgcgatcgcgtaactgtcgatactgaactcacaaaatcatctacaactggcttcggtaaccctgttagttcaactcaaaactaaactctgtgaaacaatctttgtttagtcccttgtatttttatacagccgtgctacacttagtattgttatattaacgaattaaataaaaactgctcattcaatattacgatattgaacacgacccatacttgtgaaagatcaagtacgggtttttttaatttcttatgtttggagatgacttgcatgctaagattttggggacaaccgaagttttcacgcgaacctttagaacccattggatatgaattatttttacgtgaatacaatactggtaattgggaaattccaaccgatttcagtaaatttacagctacacaaattacagatcttctaacgcgaacaacacctgagttcccacaaaaaatgaaacacatttcgattaatttggacattgatcaatttgtagatcctgtttttttacaagctttttttgctataaaacaacagctttctggcattcagttatccattgaattaacagaaagaacggggcaactaaacatttcgccttcccaattagtcacagctgcaaaacgttttaacgacgctggcttttatatcattttagacgatgtcagttctggtgataatcaattagcacgggttaaactccttaatgattttgttcacgaatataaatttgccattcaaaatttccgtccgtttgaatctttagaagatattgtgcccaatttaacgttctggcgagatttagcacaaaagaatcagaagttgttcacaattgaaggcgttgaatctaaacaagacttgctaatcctttcgcgctatcaggcagatatgtttcaaggatatgcgcttggaagaccaatatatctgcccactcaggatgatcctgatagcgtaatctctgaatctactacttgttattaaaaatcacttaacgtacctcgtaattatccagtttttggataattttttttaccaaaaacctatgataaatagcattcctttttctcattttcgatatcaaaaacacctttagtttaaaaaatagttttcttttgtatgctcgttaaaagctaaaacaaaaaaatcgttttcatttatcattgttgtctcactattatttgctatgattaaagggcttaactaacggtatctgttagcaaatagtcacctgaaattttattagatatacaaatggttattatttaattaatgaatactagttagaattcttagttaagagatgattaatattgactgaacacctctggttcttatcgccattatttactggcatttttgttaccctcggcgtaattgtattctttcaaattctagttcgatcgataatttcccgttcaggaaacatttctgaaaccatcaactatttaacaggtcgactagcgatttttagtgtgtgctatttttctatccttggaatctattttgaatttgtggtcgctcgagaagggcatgacttagctttcgttaattttcgtctactattacttttctatgtaactatttatcttggcaaacgaagtagtgccgtgattgttttgatgagttttcttgcacgaattattctgtggggattcactgctgggacaatctacttctttacaatgacggcaataatttatctgcttactttgctattagtttcgattgtgcgtaaatggcaactaccacaaatttttctcattggctctttagacgttattttaggtgtcctgtggcttgtgttcaattacttacagcttccttatttcggtgctgtaacctggaaaatcacgcttttcaatatcttcagttttgtcgtaatgaacgcggttcttgaatttggaattagtcatttaaaccacgaaaatgactatttaactttgcttagtcgccaggccactacggatccactgaccaaattaaataattatctctcttttaaaaacgatttagaaactcaggtctcggcatttcaacacaccaagcatgccttaaccatgttagctctggatattgattattttaaacgagttaatgacgaccacggccacctaactggaaacgaaatcttacaagctgtcggcaaaattcttgttgacgagagtgaaaagatgccgaatgccaaagtctatcgggttggcggagaggaatttaatattattatgcctaacacagacttaccagaggcggcaaaatttagttaccacttacaaaatcgtattcgtgaaacaacctttcctaccaatcatttgaaattacaaattacggtttcaatgggtgtcgctaagttggggcccaatgatgtgacctcaaatttattttacgaacggacagaccgcatgctttatcactctaaaggccaaggtcgcgatcaagttaccattgaaaatgaaaaataaagttgtgacataattaacttatgtgacaacttttttcattttttacgtatttatttaacgaatagttattcaagttttcggctaaacaaacagcgccataaagggcttatggatgactgatttttagtttaagatgcagttcaaaatttatcggtcttgcccacttgaaacgctattgtagtttggctttattgtgctaaaataatcgtcaattagactgcttaacaaacgataaggagtatgtttggtttcgtgttatgtcttaagccgtattggaggagctactatgattcgtttctggggacaatctaagttttcagttgatccactaaaaccagttgggtgtgaactatttttgcgtgaaaaaattggcgatagttgggttttaccagacgactttgcccaatttccaccacaacaaattgcggacctccttttgcaaaccatccctgttctttccaaagatttaaaaaacgtatccattaatttagatccagaacagtttattgatccagaattctgtgccgttttaagtgaagttaagaatcagcttttaccagttactttagaagtcgaactcaccgagcatgattccaaatttcccgttaactcaagtgaaattcaaactgcagccaagcatttttttgaatccggcattgatttgatcatggatgatgtgggttccggtagtaatcaaattgatcgaactttattgttaaatccatatataagcgaatataaatttgccatccagaatttcagaaaaacacggtcattaacgtccatcatccatagcttgtctttttggtgtgaattagcggccaaaaataacaaactttttacagtagagggcgttgaatccaaaaccgatttacaacttttaattaactatcgcgttaacctgttacaaggttttggtttggctcgtcctgtgtttttgccgatacaagcggagcgttccagacgtgctgttttaccatttacacagaaataatttttcgttctaatcctgtattaaaatcaacatgagccataccaagtcgaaaaacctagtatggctcatgttttgtttttagctaaggttgaaagtatcaaaatgacttcaataactagtattaaacgacttggttcaaaagcagtagtttaattgctgtcctgcggctcacttggtctggaagacagcaatttaatctgattttattgccatgaacgttttcgtatcaagcaacaagataagtttttggagtttcaacctttagtttttagtaataagctgtgtaaaacagataagccgccaaaccaaatgcagaaaacgaaatcgcaatccgcaagggttttaccggaacatgacgaatgacaactggacctaggtaaccaccaataaacatcccgattcccaatggtacaaccatccaccagtacacttttgtagtaaacgcgtaaataatcaacgacaaaatgtttgtcataaacgccgcaaagtttttaatcgcattaatctcaccaaaactgtcattgagcgtcacaatcaaaattgaaagcataatcattccagccgatgcaccaaaataaccaatgtaaacaccgaccagcaaaattgcggtattttttaaaattgtcgttgccagatgatttgtatgatccactttcttaggtacggtgtggcgaaattgagaccaaagcattaacagaccagccccaaataccaaaaaaggaacgacccgttcaaaagttgttgcgggcgcaattaccagcaagaaactgcccacaaccccaccaattaaggcataaattgtgaccttcaacaccgtttttcgaacgtgatgtaattctcttaaagatgacaaactagagccagcacctgtgaaaattagcgctgctgtgttcgtcacgtttgcactaactgggggtaatcccaacattaatagcacaggataggaaaccaacgacgccaatccagcaatggatgacaacaggccggccgctaatccagctgccaacaaaattacagacataagccaaagtgacaaaataaccaacttctttctaagtcattcgctataccgtgacatgggcacgcttttccaaatgttgcgcccaaacattgattgccaaagacaccaacattagcacaagcgataataacataatgttgtgtagcccattatgcaaaatggctcgcatctgtggcaaaagtttggttggcaaagaattaatatttgtggcatcacttaatttattcatcattttcattgtcacggcgccgtgcgagcttgaaacaccgtggcgaagcgcactattcatgacaaggccaaagatagatgccgtaaacgtttggcttaacatccgaattagaaaactaaatggcgtggcaaccggaacatcccctaaatcggcatcttgttggaccttcacttgaagttcattgaagcaggcaccattaccaaatccttcaaatgctcccgctactaataagacccagtagggcgttttaaccccaccgattactaagaacaggaaagatgcaataagcatcacaatgccaattgccaccactctttgcggtgtaaagtatcgccgtaaggttgccacagagcctgatcccatgaaattcgtaaacgaacttggaatttgagtagcacctccaattaaagcagaagttcccagtaacccttgtgcccacattggactgtaaattaagaaacccacaaacgcaccccagattagggtaaacagcgtaaaatcaatcactaattctcgatttttaaataggcgactcggaataattggatcggccacacctctttcgaaataaatcattgccccaatgcaaatggcagcaacgatcaatgccactgtcacaaacaatgtactggctgtgccaatcatttcgatgccagccagtaaactggttaaaccaatggtcatcaaaatggaacccatgtaatcaactggtttattcttatgtgcttctttttctgctttgtaatagatttgaactaaaattgctgaaatcaaaccaataggtacgtttaagtaaaagacccagtgccatgaaaaggcgtccacgataaatccaccaactagcggaccaatgatcgtggcggtactgtaactggcagagacgaaccccaacactttcatccgtttgcggggatcagcatacatccgagcgtaaataatgtaaggaagcgagacaactccaccgttaccaattccagcaattgtccgtgagataatcaaaaagacaatatttggcgagagtccttgaagtaaagaacctaccacaaaaaataaggccgcaagttgataactttgtttgttcccaatgtgttcaccaagtttactccacagaggtgtactaaccgctgttccaagtaagaagacagcgacgatccaacccatcatttcaataccatgaagatcagaaataatggcgggcaaagcagtattcacgatggtactatccagtccactcattgcattcgacaaaagcagtgcacaggtaacaataaaaatgtttcgttttgacaagttcttcgcttcttcctccaaaagttaactagcttttatgttacaacttattcccatcctggtgtaaattatatttacttttctatagtaaaacgacgaaaattgccacataaaaagaccaaagctctagactttgatccattcaaactgttctaatcaaatagaattcaaaatttgttgatgtactttcaaaacaacggcaaaagacgcatcatctaataaaccgccagcatattcaacatgccttccgatcacactaaatgtatgaaactgcagtggatttacaaatccttctatcccaaaatctgattttataggtacaaccatttctttcaatcgattgtctgtggcatgggtaattggcgaaacagcaactagacccgtgacagctgtgtaaccactggtgcttaaaaccactgccggatgcctcccccccaatctcatttttcttagaaggttgaaagttaatccagatgatatcctgttgttccggaacataattaaaattcatctttccttagctccgtttcaaccaatgtttcatccaattttccttgatgcgttctcacgaaattttcgtctgtaaaaggatttttggttttgggggtataaacaatggcgccgttacgaccataaaatacgtcgaattcagtttcacgaggtttaatactgcttgggacagtcaatacattagaagttcccacttttcttaattttacgctccgcatattttccgccaacctttctttatatatattaaatgtatatcatatctgttggtcaatgatttagcgagagtgtcaaattttatgtgtaaatgaaaaagcctctcacttttgaactaaaacattgattctaaagtgtcttgaactaggttgaaccctttatgtgttcgtcgcccaaatttgtcattgtaatcaagaattacagtcattaaggttctttccaaagattcttcgttgggaaattgttcacgtttctttgtttgtcgcttaaattttttgttaaatgattcgataagattggtactataaatactagacaaatgccgaaatatctgtaacttcgcacgcatgtgtcctgatgtttctcaaaacaagccaataccactgatgatttggcaacaagcaatcttgtgcctttctcagggatggcgaacaaaggaagacaagcagaagcgatttgagcgatgtatggtttcagtggctcggactaatggcaagtcatatctattgaatatcttgatactttacgcttacttggtcgaggctagtgaccagtttaacgccgatttatgttacttggcgccggttgataagcagtctaaaaagtcttggcgttacattaaacagacttttaacagcttacaagaaatgcctggatttcgtaaattaatcaaggatcagaatattgcgattaatgatgatgttttgaaatctacgaagactcaaaaccagatattacgaatgacagctggtagtgcacaattagatgcctttcatttcctctttgccactgtggatgaatacggggatgaaaactttaattcagatgtgatttctaaagtcacatctggacaagttcaaaccagtaaccggcaaacattttttatcagtacggcatacagtaaccctaaagtcccgatgtatagtgatgttagacgacttactaaggtgatggaaaaagattctaaccgaacggaagattcaacgttggcattaatttggcagcaggatgatcaagatgaagttgagaaccccgaaacatgggtgaaaagtaatccattactagatttaccggctaagcatgataccctactgaaagggttaattagtgaacgtgattctaagctagaagacggcacattaaatgatttcattaaccgtaacctcaatatgtggttgcagactgctaaagataaatatttgaaattagaggatatacaaaagtcagttgtttctgattttgaaattgataatcaagattgctatgtgggttttgatttatcacatgcttcagatgatacggcttatagttttgttttcccacatttgaatggcgaacaaaagaaatatttcatcttgcagcattcatttgttccgttagcccgagcagataattccattattgtgaaagaaaaacaagatggaattaattactcaaacgcagaaaagttaggcttttgtgatatttcgcaaaattcttatggcttaattgatgaagattttgttgggcgctggttcctggattttgttaacgatcatcatttgaaagttaaggccttcatttatgatccttatcaggctagtgcgattactgattggttggataataatatgccagaagtgcctttcattactttaaagcaagggacggttagtttgagctcgccaacagtctttttgagaaatcagtttattgctggaaatattgaaatgttagccgatccgattttgcaaacctgtttggctaatgctgtgacgctggctaatccgtatggtattaaaatagatcgaacggctctgacttcaaaaattgattgtgctgatgccactattgatgccatgtctcaagcccttttttattttgaaaatcctaatcatggtcttaaagaagataaaaagaatccctttaacgggatgagcaatgaggaagtcaacgaattctttaccagtgatcattttagtttttaatattttcaacacttgttgggtgatatatgtagtgaataaattattagggaggcagattagttgaatctgaaacaactatggacaggtttaatcactaacctgtcttttatattatttttatttgggttaattgcatttgtggttgcggcaagccttattaattttattgtaggttgggtagtggccgggattgctttaatcgttttagcctatgtcatttcgtgaaaggaggcgttgaatgctgaacccctttaaaaattttatgtcaaaacaaacacaaacaattagtaccaccgggtattcaccatttatgttaaatggtacattgttatccactaacactgtggatgcagacggagcactgcaaaacagtgatatttatgcggtgattaatcgaattgcaggtgacgtggccagctgtgaatttaaaacagaccaatatagcaacatgctaaatcagcccagcacattattgagtgcttataatttttggcaggcagttagtgctcaaatgatgttaactggcaacgcctttgttctaattcagcgaaatggcaatggaagtccagcagggttgaccttaatcccgttttaccaggtcagcattactttagataatcaacaaaatgttctttattacacagttaattacggtgatgaccgagggcaggtgacatatttagctgccgatattttacattttcgcttgtttgtttctgggcaagttgccactgaactagtgggtagcagtccgctaaacagtttagctaaagaaattaacatccagaactatagtaatcaattgtcactgagcagtttaaagaatgcaattgcgcctagttatacgattacggttccggcggccaaattggaaccggaagctaaagaaaatattagaaaatcgtttgagaatcagaattctggttcgaatgctggtcgaccaattgttttggatcaatctgctcagcttgattccttacagattaatccggatatagctaaattattaaataatgccacgtttagtcagacccagattgccaaggctttttgtgttccagatagttatttaaatggtcaaggtgacgaacaatcatcaattgagatgattcgttctttgtatcaaaatagtttgagcctatatattcggccaattgaatcagaattgtctttaaagttgggaatcgacattaaaatggatattaattcggctattgatgttgatcatcagcaattaattagtaatattactaaattaagtactggtcagtcaccagcattaacgtcgcaacaagcgcaaacaattctgaaacaagcgggagtttttcctgatttgaaagtttcagcagtggaaggaggtgatgataatgacaacagtaccaattaaaggtgttgtatctagtgatgatgatgctgaagtatatgaattctttggctattcaacagttactccttccgcagttaaagatgcgttaagcactgcaaatggtcaaaatattgttgccgaaattaattcacctggtggcgatgtgtttgcgggttctgaaatatataccgcacttaagaattataccggtaatgtggaagttgacattgttggattagcagcgagtgcggccagtgtcattgcaatggctggtgatacgattaaaatttcgccaacggctcaattaatgattcatcgggcttccactgtatctcaagggaatgcagatgatttatccagcgatttgcaggggttgaactcgactgatcaatcaattgcaaatgtttatgtgcaacgaacgggtttggatccgcaaacagtcatgcaaatgatggccaaggaaacttatatcaatgcaaaagatgccgttgaacaaggatttgcagacgaaatgatgtttgcagatcaaccagccaaagttactaacatgatgtcgcccttgatgttgagtaatcaggcaattagtaaaattaaatcattgttaaccaaagtaaaagaaaagcctaaagaaactaatagccaaactagtgaccaattacgatcacataagttggctattttatttaagaaagaaggaaattaaattatggatttaaataagctgcacgatgcttggcttgaagctggtcaaaaagtaacggaccttcaagaaaagcgcaatcaaatggcagttgaactgaacgattctcctgaaaaatattcagatgaggatctaactaaaattgctgattcaattgataaagcaaagaagacccgagattttgctaaaggtgcatatgatgatgctttagcaacggctaaactggctcagccaggtaaaccagctactggtggccagaaaaatgttacaccaaaagacaaacctaaatttattaatattgttaaaggagccttaaagggcgatcccaaattcttgaatttgatgtctagtggacttgatgccaacggaaatggtgttggtttgactattccggcagatattcaaacagccatcaacactttaaaacaaacctttacatcattggagccactagtaactgtggaaggagttagcgcaccatctggttcacgagttattgaaccacgtcagtcggtaactccatttgctaatttggatgatgaaacagcgcaaattggtaataacgatgagccggcagcctttaagccattaacttacaaaatccatcgatatgcaggaatttccagtattaccaacactttgatgaatgacagtgatgcaaacctcttggcatatttggaaaattggattgctaagaaggatgttattacccggaacagtgaaattttaaaagcgttggctaaattgccaaccacacaaaagaccacagttgatagctttgacgccattaaggatatttacaacaaggaactggacccattaatttggaatgaatctgcctttattactaaccaatcaggctttgctgtcttagataaggtcaaggataataacggacaatacgtcattcagcctaacccgcttaacccatcacaaaagatgctggctggtaagacaattacagttattgctgatgcctttttgccaaacgatggtaacagtttcccactgtacatcggtgctttgaaagaagcagttagacttttcgatctccaacagatgtctttgttggctactaatattggtgctggttcttttgaaagtgacttgactaagattcgtgccattgatcgctttgacgttgagttgtgggatactgaatcggtcatttatgcaccatttaccggattagcagatttaactcctgctgcaaagactagtgggactactagttcaactggcaagtaatttaaataagtcgccaatgaaataaacaatacagtgatgggcggctgttaggaggggtgtcatgtgacggttaatccgacagaattaatggatgagttgcatattgaccaaagtccgactgaattaacgactgttaccaatttgattaatgaggcaactgagattgtcaatcattcagtcagttcaactgaaacccaatatcaagcctcatcaatttacgacttagcaataaaaacactggcaactcaattatattatgatcgggaattatctaaagggatgtcagctggtttgttgatgatgctagatcaactccaaggaatgatttcaggaagtgatccggatggcacttaataaatttagtccggagcagtttaatcggcaagcccagtttggaatggctttaccaacaattaatcctaatactggtgcatcaggaacgcaatttaaaccacagttcgtgttatggtgcatgccttatacgcgaactaacacacagaacgtttcgcttttgggaacagattttgaagatactattcaaattgttattcgacacaatccgttaattgacaaaggtctgctagttcaatatcaagaccaactgtatcaaatcgttaatttgagtttagatgatagcaataaaattgtgacttatgacattttgactctacagattaatgagagggttggtaaaaaacatggttagtatggccgaacaattagacgattatttagcgaaaataaaacgattggtacccaaccgggcggaaagaactataatcactaaagccggtgccgatgttttacaaaagaaattagctgatgaaactaaacggctacattatagtaatcgaattgctaccggaaatgatcctcacttggctgatagtgtattagttagttcgaaaaatattgatggtgatgtggatgggacagcgacagttggctgggtcaagaaaaaagcagtgattgctcgctggctaaatgatggcactgtttacattgtcggtgatcactttgtggaaaagacccgtgaggaaactcgttctgatatattaaaatctgaatatattaagtggaaggagctgggtcactaatggaattaccagttatgactgtttatcagttaattcaatctttgcactatggttggattgaccagctttattccatgaacattcctcccggagctgatacttctggaaagcagaccattgtcttgattacttccattactgaaccgttgggcggatatcggaacgatcaatttagtaatatgcaagctaatattcaagttcaaatattttggaaaaaagatacacaagaaaatacttttaatgaagaagttgccctaatgaataatttggaaaatcaggattggctggttagctcacatgagcctaacactgtggatccaaataccgatcaaattacgtcaactttttcagtttctaagacaattacaatgaagaaagaaggattttaaatgtcaacacatggtattaaagatgtcacctttgggttagttgatgcgactggcaaattgctcactggtgatgcaggagtaggaactaatggtatctatttagttgatggcgacgaaaaaggcgctacgacggccacagtttctggcttggaagccgagggtactgtcgcctatgctaatgatgaagcaaaacgagtttcaaatggtcaggcacaaccacaggtcgcattggaattcttggatattgattttgacgagttgcaaaaactcaaaggatatattcaggatgcggctaatggtggttggacgcgtcaattgccaaagccccatgtagcaatgttgttacattttcgttcatacacgaacattgatatgtacgaaggctttgctaatggtcaactaattgaaactggtagttctcatgcaacggataataatgctgaaactgatgccaatacggcgttaacttaccaagcattaacaccggctgacaataccatcttcaacggagaaccgtacaagatttggatgtctcaagacgctgggtttgataaagccaaaatgttagcagaagtttttggcggttattcagcaactaccggtagtagcacgactggttcaaccactggatcgactacgggtggcacaactggctcaacgactggcggtacaacaccaggaaaatagatcaaggcgggggatattccccgcatacataatcaaataaaataaaggagctttgatcatgaaaattaatattacaaaattaggtttacgtaaaaagtcagctgaagttaaaaccactgtgggtgttattgagaaagcccaaaatttacaaattcaattgttgaaatcggatgcagttgattttactaatgatgacccactagcagttttggaaacgcaaaagaaaatggttcaaggattattgcaatttatgattgatatttttaagctatccgacaaagaagttgaaaggattaaatcaactttggacttcaccgactttcaaaatttcatggcctatgtactatttagatttcaaggaatgagcgatgaagattgggaaactgttactaaacaacaaaccgaggaatcagcagacccaaaagaaaacaattaagattagccaaattaattaatgacctaagcatatcccaacaagatatgcttttttttaaacaacaaatgatgaaacagggaatcttaccagatgaattaaatcggcaagattactttgagtttatggcagtcttaaatgctaaagataagaaaaaacaagttactgatccggttgtcgagttattaaataaacgaaaggggactgactaatggctactattaatgatgtaatgagtacttcaattcgcttggatgcagtgcagcccgcacggtcattaaaaactttaactaattacattaaagctaataccaatgcatggcgttctcaggaggtggccttaaaatcttctggagataaactagatgctttaaaaactaggtatcaaggaatatcagaagaaatcaaaggttataacttaaaaattgatgagctgaaacgtcgacagtcaggcctcgatcaaacaaccaaccaaggttcagaaaagtatgccaaatatgctaatcagattgctaaagcacaagagaagattgctggtttaaatgatcaacagtctaaagcggaaaagcaatttgaataccttaattcaggactatctggattacagcgtaactatcatagccttaatcaagtaaccaattcttatgtagatgccttaaaggctcagggaaagattaaccaagctggtcaagcaaaacttaagagccttaaagaaggcctgaatagtttatccgaccagtacagattgcaaaataatgaacttaataaaaattcgcagacttataggcaagcccagttagcttatgaaaagcaacgaaatgttgttcatgaacttgctagcgatacccacaagaatgcagatgagtatgcccaagaaaaggaaaagcttaatcaattaaaaggtagcttggacattgccaatgaagcctttaatactcagaaagtgcgagtcaacaaaacagctgcttcactagctaacgttcgttcagatgtggttaaatacgacttacaagtcggccacatgagtgatgccatggctcggatgggtgacaaagccaacgttgctaagaataagattaagaattcatttggatcaattaaaggtagtttactaggtgctagtgtagcgatggggacattgggagcagctgcattttctggtgctaaaaaagcgactgaacttcaaaatgtttataaagtaaaccagaacttgttagttacgggtggtgataagactaaaactgccattaagaccgtgaccgaaatgcaaaaagacgggactaaatacgctctcaaatatggggttagtcaaaaagaaattgctgatcaataccaggatttaatcaagcgtggtcatacaggtgctgaatcattagcggttatgaaaactgagctacaggccagtgtggcttcaggtgacgactttaaagatgtggttaaagtatcaagccaggctattgaagcatttggcatgaaaaccaataatacggcaaaaatgatgcacaacactaaacgtgtagttaatgcattagcttattctgctgacatgactgctactgacttccaaagtttaggcaaaggtatggaatatgtaggcgattcagctaataatgcgggctttagtattgagcaaacttccgctgctttaggtgaattgagtaaccatggcttggaagctgataaagctgggacaggtctgcgaaaaattattactagtttagcatctccaacaaattcagctatgggcgctttaaatgaaattggaattaaatcaactaaaatattccaaactgccaatggtaatttcaaaacgttgcctgcaatttttaaaattattgaggaacatactaaaaaacttggtggagctgatacagcgcgcatctttaaaaatgtttttggcccaactggtatgcaagcagctcaaatcttagctagatataatggtcagttagctgatttaaccaacaatgtttctaaagcaagcaaagctgggacttacgttcaaagattagctaacaaaaatgctcaaactgcccaaatgtctcagaaacgatttaagcaagcctgggatcaattatcaattatgtttgggtctaagttactgccctacatgacaaaagcggctaatcaaatgaccaagctttttggtgaaaaaggatttcagaaagatattggtaaaacggctactttaactgcacatgttgcaggaggaattgccaatattggtatttttgctgttaagcattatgaaggtgtcaaacatttcggtgaagcattagctgcaatttgggcagttggtaaagtttataaatatttcaaaatatttagtgatattacctctgtctttggtggtcaaaagctaaaggtgaaccgattgacatcagcatatgatgatcagacactagccatcgaacgtaacactaaggctaaagaagccaatgtggatgctggaaatggtaccagtgcaattgatgatattgctgataactctggtggcgaaggtaaggttgccgaaggtgccgaaaaagatggcaaaacggccatccacgatatagatgatacaagtaaagttgccgaagactccggaaaagttggccgattagctaaattagctggtaagtttaaaggcgttagtaaatttggcaaggttgcggctggttctgtcggtgttttagatgtcttaaattcggcaactgatttaattggcatgaaaaagaagagtgccggttcacacattggcgctgctaccggttcattaggtggtactgcagtaggtgcagcaatcgggacagctatttttcctggaattggcacagctgttggcgctggtttgggtggcttggttggtgaaggtgttggtcgtaagtttggtaaagctattcaaaaaggactttcagcacaaaaaatccatacacctaaattatctactaagtcttctttcaagaaactttctgatgaagcgacaagctattataaaaaccgtgaagctcaggacaagaagaacttacaattactttataaaaacggggacattactaaaaaagagtacgaaaaacgcctacaaattattaagggtgaaggatctaaagccaaccgattaactctgatgagtcagaaagatcagcaagtaattgccaaatattatgcacaatcacgtcaacgattaaccgaatcgtggaataaaaagattctaaaagctgagaataaatacggtaaagggtccgttcaagttgaaaaaatgcagaaggaaaagaaagaagcacttgagaaacaacatcttaagtttgctactcaagtgactgctaaagaagccaaactgcatacaaccttagctggtcagattaaattgtctactaacaagattgcaaaagattacaaaactcttactgaaaagggtaaaaagtattctaaagaaaaaatgattaaattggtggcaaacgctgatgaagaacaaaagtctgtcagcaaaaaagctaacgatgaatatcatagtgtttataaagcggcttggaagaaatataaaaatacagttaaagcagcagacgaagagtataagggaaatagttcagctgccaaagctcaacgccaaaagattattgaagaagctcgtaaacagagaattggtgtaattaatcacgccgctaagcaaaagaacgattcaatcactaaagccaaacagcagtctgacaaagtgtacgattacgcacataatcaaaatcgtaaagtaacggctcaggctgtttctcagtatgagagtattaagaaaaataattccaaaaccaaagacaattacagtctctcctggcatggcatctggaagtcagttggtaattggattggaaaattagttaatgggatgaataagaatgccatttcagcccagaacaaagtctttaaacaatacggtggttcacaaactttggatcagatcccagcggtagcttgggcaacaggtaccggattgttgaaaaatggcttattaaccaaaccagttttggctaagcttaacgatggccatgactcaccagaaacacataataaagaaatcattgtccacgcagatgggcaattagaaccagttgagggtaaagatactcaccggtttctagaagctggctccggcgttttaaatgcgacagagtctaagatgttaatggctttaaatggcatgcagcactttgcgtcaggtactggtttatttggtggtatcgggaaactctttaaaggcatttggggttctttaaaacagaagttgtcggcactatcacacattgcgaatcattctgatgcaactttcaaacaagtttttcaacctacttttggcgatataaagggaacagttgggaagaactttgccaatatgtttggtaaacgggacaaacagcaggggtcagtttggtgggatactgcctggaatatgctacatggcatggtttccgaaggcggcggtcagactgattcagcatttttgaatgaagctaagaaattggcaaatcgtgcccatcaccgatattctgaaggctctaatgtccgcttaggaccgaattattatgattgttctggcttagtttatgagacattgaaacacatgggaattacagttccaggtggatctaccacagttccggaatacaaatactcaaagcccgtatcgtggaagaatgctaagactggtgatttggctttcttcggtgctggaggaagccagcacgttggtattgtggtcgataatagtggctctggacatatgttcagtgctgaaaatccaaaggacgggattaaatattctaccatcaagggattcggtgattttgttggaattcgaagagtgcctggattaattgacaaagttaaaaagtcaactaaatctcataaacaaagctccggattacaagcactagtaaagtcgcaattaaagcattccggagtttggagttgggtatcgaaaaatttaaaaccattatggcaaaaattgttcggtagtttaagcagttttggattaagtggcgatgtggcagctagagctaaaaccttagctaaagcattgaaaaagctggatccacgcgcaactaaagcaggaattgctgcaattcttggtaattgggaatttgagtcaggattaaatcctaacgcaagaaattcatctggtggagcttctgggcttgggcagtggttaggtggtagactgaatcatttgaaatcatatgctcatcgtcatggtgaaaactggcgcaatgcagctacccaattaaagtttgcgttaagcgatgacagttctgattcttctgtatttaaacgaatcctcgagggtcacggttcgatcacttcgttagctagtcagttttctgaagactgggaacgtggtggctatacggggcaacacgttaacggtgcgaagaaagttgctaattatttaggatattcgaatggtggcttagttgatcaagaacagttaattaaagtagccgaacgtaacaaaccagagaccattattccgtgggatattaataaacggggacgagcctatgaattgttagccgatactatggctcattttaagcaaacagatcagcacaccaaccaatcaagcaattcggatggtcaggctgtcaaaagacttgaagcaaagtttgatacaatgattaaacttatgagtcaattggtcgatggccaaaacaatccgattccggcagtagtgaatgacaagcaagttgttcaggcagtcaataagcataacaaacgaacaacggctaagaataattggggaagaggtgtaacctttggctaataacgataattatgatgtaaacacatttgattttgcgtttgatgaagatggaaatggtggttttaattcggaagacgatttaggcatatttctaaatcatgtatcgaaaccgttagcccccaatattactgagtcatttcaagacgtccctaaacgttatggtggtgtgtacttgggaacagactacggtgaaaaagaattcgacattccaattacctgtttctgtaccacccgcgatgaatataacgaacgaattaaaacattaactaacgttttagttaataccagcagtgatgctgatactgaatatccgttaaggtttaatgacgatccagatgtaacttattatggtcacttcacaagtattccaacaccgacatttattaacgagggtgttcaggattttcaaactacgttagtcttcatgttggcggatccacgtggatttctaccacaaaaagaaataaaaattacggacaatgatcagcaaattattcctgaaggaaatacggaagttgatccaattattcatattattccaaaaaccgatctttattatgtgggttatgaaacaaatgatgattatgtagcggttggatataacgttgatgatggtgatacggctacggatagtgatggtaacattacagtcatgggacaatcccaaactcaacaggttgacgacccatgtaactcattagcaacgtggattcaatgtggcgaggatacacaagcttttccaatttataagggtgagttagatggaaaatcggcagccactggtacttcaattatggtggctaaagataaagatgatcattacgaatggggatctcgtgggaaacacaagaatttttacggaccagcggttatgcataatggtctaccgaaaattactccctattggaaagtttcggtacgcttacatcatgttaaacgaatgaaaaatgagcgggcgatgggaaaaatcgaagcttatttgttggacaataacggtaatgtttgtggcaggatgggcattgaagattactcaatgggacggtatccacgggcgtttattcaattaggtaataattttgatagtagtaactctgatagttatttgacattgctgtttgatgaaggtaatggtcagcagaaacaaaatgaggctaccaagcatgttaaagttgcctacaccaaaacggtcaccgttaagaagaagaagacgactaaaaagaagaagtgatataaatgaatctacaattctttgcgcggaagaaacgaaaaactcgtaaaaagactaagactaaaaagaaacgagttgtaaaagccaaaaagggtggcaagaaaagtagtagcaaagggggcaaaaagacatcagctcccaaagctacaacgaaaaagaaaaaggaaaaggaatatgtaactgaaacctcttatatgaataaggacgcatattcgaacttttatggtgaatttattcttgaacgacagaaaaaatcggataagtctggtaaagtttacgacaattgggtagcagaaattaaccagtgggatcctaaaactggtgaaccatatagtgttaataatacccataaaactcacatgcataaggaaaagttggataaatacggtaagtttggttttgctttagccaacttaggcgttttctttggtaagcatgatattaaagaggacttagttaatccagtggtggcgtataagtcagattatgaagctttaaccaattatgaagaatggcgcagtgatggctctactgatccggatgatacaccacatattattgccaaggctggtcaagaaattattattgatacggccaacaataaagttactattgatggaaagccggccgataaatacgtttcatggttatcgacttttcctaaattaactggtggagttccacaaactctacactttttcccggatcccaaaaatgctgatgtaacaattgaatatcgaccagcaattaagtagtcacgaaagcggctacttttttcatacataaataaggaggttagagatttgtatattatcctggataaaaatttaaagcgagttgccacgttatcgactaattcagacgccaacccgttttggggtgaagtagttgaacgccaaattgccgatgataacagtaactcggatgatggtattactggcgttagcacttttaatagtacagatccgaatgctaactctaaaagttggaatgatacattaacaggactaaccatgttgcaaagtgcccctgcggctcaatacttaacggttggtaatagtgttgctgtgtatgatgatgtgcataatcattggcgtatttatcgaatttatcaggttgatgaaactattgatgccactagtggggctcacttagtaacggtggatgctattaacctagcaatctataaacttaataagaccattccaccacaaaaagaaattaaagattgtaaattagatcaagccatgcagtggattatggctgataccggttgggatttacaaaataattgctcttcaggattatttgccgatattaactttgatggtacggcttctagtcaagcagccttgcagacagtcttatcaacttacgatgcggaagctgatgcttattgccatattgactccaacggtattgtgactgatctaattttagaattagctgatcaattgggagaagatgaaggtaagtcaattacttatgggcaaaacatgttgtctgtccaacgagaaacagttgatactaatttggttactaaactctatatcgttggagcaaataatgcttcaattgcagaggttaataatggtaagaactatattaccgatctatcggcaaattctctttataacaatgatagcaatacctggctagaagggacgattactagtgacactattactgaacctaaagcattacttgattggggattacgtgaattaagattgtacaatcatccacgaattaactatgccgtggaggtaactcaagattttcaagctaacttgggcgatactattaaggtgattgatttatccatgaacccaattttgacaacggaagcgcgagtcattcagcaaaccacttcggagagtgatccaagtcaaaataaagtcgtcttgggtgagttcagtacagttaaagtaattacgccggcgtttattcgcaatatggaacagcgttggaatgatcacgttaagaaactatttgaagaagcccgagagaatgccaatgcagccacagtcagtttgattacgccgttaggttcaacttggtataacacggatacttccaaacgggtgattgcaagactatttattgaaggtgagaatgtaacctcttatctgtcaccacaagcttttaattggcaaaaaattaatatggacggtacccgtgatattgggtgggaagctgaccatgcaaaagatggttatcaggttactattgaaccaccatttgtcgggacactattagtcaccattgatgatacttatgtgaaagatgaggcagagatgtggattgataccagcaattcagctgatggttcctggaataagctttgggaaactaaagatgccgccaacaaagattttaatggcgatcagcatattggggccttacaattttcatatttattgagtgatggttcggtgctgtctagttatcactattctaaagacaaaaaccattcagattgtgaatttattaaatggaacgctgatggaacattacagagcatgatgtttgtaactggtggtggccattgtggatcgttcggctatgatgaaagttccaatacgatttatacagaaataaaagatccaattgatgggaaatattatttagtaactcttccttaccaagcaaatacgagtgccagtaacataaccaagtggtgccaagtaaaacaatattttcgagttgcagttgatttgaaaaataatctatggctgggaagcacgacgagtgggaaagtgtatgtttgtcagataagcgatttacagacaggaaacttcaaaccaatcattgaatttaaattgcaagattttaaatggaagccattaccagctggaaccactaataatggcgcttataacactcttcaggcaaatgggattagttatccatttgctttttttacggcgggtgatgctaacaatgctgatgacaaacatgttatgtgtattaacttaattacacagtcaatggtatttgattatgtggtggaaccaatgcaggatattaagttaacagtgccgttggaaaatggcggtcatttggagcccgaaggtgtttatgaagatgttactaattccagactaattgttggctttaatgtttctgaatatagggatgctgcacatactgtctctattgctcatagtgccctatatacagctccacttggaatccgtgatgattctaaagacttagttgttgaatatcctgaacaagatgaaggcgagaatgatgaggctgaacaaccagtaattaccggaaatgataatgctgatgattcagatgatagttctgatagtgatgaatcaactggtgaaggaacagaaattgaggatggtgataacaattgattattgcaacggggacgttaaatattgatgaaaatgctaaacttgcccaacaggcctctgacgatgcaaaaaatgctgctaactctgcggctgatgaagcgggcaaggttaaaacatcgttggatgggaaaattactgtttcatctcaagaaccatttgatgatgggaaaacccatgatgaaggtgatatttggtatgttcaagacagtaatcatataactagtgaaatgtacacctatgatggatctgattgggttaagactaagatgtcccaaacagccttgtcagttggccagctttcagcgttatctgctgatttaggaaccattgaagccggatatttgaattcggtagaaattgattcatcaaccattaaagctgcgaaaattgatgcaacttcaacaattacaggggcatcaattgaggaagatggtaataatggaaggatcacattagacacaaacggtttttgtgccattagtaatggtaaatatcttcaatttgtatctggaaatagtaatgggtacactcaaattcgtggtggcttggatgttgattcaattaacgttggatcctcaatcattgaaggacaaacttttcaagcatatggcggcaacaatactcatattggtagtgaaaatgcatggacctatttggcagaaggaattaaatgtggtcctggaggttatatttcatcagtttcaggaactgatatttatttccacaatgaagctggtacgacaattgatcttcatgctggtgatgtcatttcacatggaactaatttacttgatgaaattaataagattgaaaagaaattgaagatgtaaggtgatctgatgaatgatattaacgcacaagatttaattaaccaattggttaatgagtacagtcaagatatggcagcaaaaaatcaacaaattgcgttattaaaaattgaaaataatcagcttaaaaagaaggtgaaaactaatgagtaaggagctcgcattcacggatgataatgatgtggttaaatatttagatacaacaacttcattaaacttagcattaactgcagacggattggcatttgatttaactaatgctaaaaccattgtgattaaaattgcaaatgacgatggatatattatggacaaaagtatagatctaacaaaaattacgaatcttttaaatggtacgattatttttttgattgatcaggaagtgatgacgacactagttcctgatgattatgatattgaagtttgggttaccatgaatgacgggacacaggcaatctttccaagtgatgggacattagggttctcaattgaagagaacttaatgagtgatactggtgaggtgatcccgacaatcactttgaatgattttcagcaacagtttaatgacttaagtagtcaaatggagaatgcggttcataatgttcaaaagggtgatcaaggtaaccctggtaatggtattaagtctgccaacaatcagtatcagttaagtgattcaccagttacagttcctacagggggctggtcagatactattttggcaacaactgatcaacttccttatctgtggactaaaattatttttatctacgatgacggaacaactaaagaaactaattttgtttccagccgaggtgacactggtagccaagggccaattggaccagttggcccacaaggaaagcagggaaacggcctggttgttagagggaaggcagataaggaaggaaatttgcccacaataggtaacaaccaaggtgacggttacttagttggaacagacttatatatctggatagatgattcatggcaaaaaatgggaagcattacgcctgatttagctgattatgtaaaagtggctgatatgaacaatgctttaaacactaaacaagataaaattggttacacacctgctgatgattccaaagttgcccatctatctggtgctaacaactttgataccgttccaacggttaaaaataatccgttgcttctcgcaagcagtttgccatcaactctcgctgacactacaaagcttgcaaactttactggtggactacagtctaatggaaatgacgctgttactactaatcaggttagtgcaaatattgtacaaaccattgacccaggcgctgacctatttactattaaacaagcaggtatttataaatcgatttggggtaatcaaaatacgcttaaaaactttccgagtccagatggatccgcgactatcatttactctggaagtggaaacactgacaatggccttcaaattactgttattgattcgtggggaagcgtttttgtcagccattggcaaggagccgcttcaacacccggatactctgcatggcaaaatgtgtcaaatattgctaacccaacacaagataccaactttatgggaaaacttcaaaagtctggaattgatgtggcaaccacaacggatgttaaaaatgccgttaatacggctactgcaaacatggttgattccagcaaacccactaactttacagcaggcttgcagtcaggaggtgtctcagtcgctactagcgacgatttgaaaagcgttgagaactcggcttggcatcagctagataataaatatataaagtcaagtgctgttcttcgtcagggaacttacgttctttataggttagataccctcaataaaagattgctttttatgttcacgataagtaacagttcatataacgataaagttacaattgattttagcagtgtagttagcaatatttctgctccaagcctatcttcatttgctaattttattgagcaaaacaatagcgtatttggtgataatatgactgttagcggaaatttgttgaatattagcttgtttagtgatggttggggttatgcaagttctctgtattgtgagtatagtgagaatggggctacaaaagatgacttttgtttcgttaattatgacaaattagtttagaaaggacgattaaataatgtttatttatgttacgtttgattcaaatggatttattactgaagatttttaacgaagtgatcattcgatgatgaatggtcacttttttgattgagttgatgagggttcttgtatgcaccaacttgtaatgcaagcatgtcgttaatcgtcattgacttcgtgacaagtctttcaaatctgccccgacgaggccgtttttatgttaaacttatcctatctttttggtttgcgagggatttagaaaatgattgcaggaattgggattgatgttaccgatattagaagaattgtcgctgccgtggaacggaatcagcatttcacagagcgtattttaacagcagatgaaatgaaacaattggctgaattgtctgataagcgccgttatgaatatatctccggtcgtttttcggccaaagaagcctattcgaaggcctttggttccggccttggatcgaaagtgagatttcaggatctttgtattgttaataacgaggagggcaaacccttcttttcgaaacaaccatttgatgggaacgcctttgtgtcgatttctcacaccgatgacattgtcgttactcaagttattttagagaatcggggttaggtaatgacagttggaaatttacgaaatgcccaggtaactgttgacctggcggcaatttattcaaatattcaccatgccaagcagcgtttggatgacggagacgacttgttccaagtggttaaagctgacggttatgggcatggggcagttcaagtggccgagattgctgaaaaagcgggcgccactggtttttgtgtcgctattttagatgaagctctccaacttcgccaggcaggaattaggctgccggtactggtattagggattactgatcctgaatgtgcccaattagcggcttccgaaaacatttccctgactgtcggttcgatcgactggcttaatcaagctgccaaattactcgacaccagcgcatttaaaggccggctaaacattcatttggcactggataccggcatgggtcgaattggctttcaaactgcggatgagcttaaagctgccgttggggttctcaacgcccattccgatcggatgagttttgaaggaatctttacccattttgccactgctgacagtcctgacgatacctatttcaaattccagtaccagaattttcaggactttatggcagttcttgataaacgcccgaagtatgttcacgtggccaattccgctaccagcttgtggcacaaagtttgcggcggcaacatgattcgctttgggattgcggcttatggcttgaacccgtccggaagagatattacccagcttccatatcagttgaaaccaggtttatcagtaacctccgaaattgatttttcaaaattagttaaaaagggccgctcaatcgggtatggtgcaacctacaccactgatagcgaccaatggattgggaccgttccggttggctatgccgacggaattccccgggcaatgcagggcttttcagtcttggttgatggccacaagtgtccgatcgttggtcgagtttgcatggatcagtttatgattcgattgcctcatgattatccttacggcacgacagtcaccatcatcggtcaatcgggtgatgctcagattactgccgatgatgttgcggattatctgcataccatcagttatgaggttatttgtggcttgagtccgcgattgcgtcgaaaatatgtatgatttttctgtaatttcatggtatattagacagtacagtaatctggaacatataggggaaaataccaatggaaaaagcaactaattcaaagcatttttcagttatgatcaatgatcaaattgcagaccgtttggaacagtttagcgcaacggttggaatatccgaaagtgcagcggttgagattgcaatcaactacttttttgatgacccgaaagtcattgatggcttaatgaggggatatcgcgaaatgggtagtttgaaccgtgagatcagtaaggacttttcctgctgtgaagaagacgctgatatccatttaactcagtatcgtcaaagattacggaatttacagtaatgtaagttacgatgatgggaggtatgagggtgactgacgttatttttaaacgtggagacattttttatgctgatctatcaccagttatcggttccgagcagggcgggatgcgaccggtcttgattgtccaaaatgatattggcaatcattacagtcccaccgtcattgttgccgcaattaccgccagaatttccaaacccaaaatgcccacacacgtggggatcttggctggaaatgggatagaaagagattcagttattttactcgagcagatcagaaccattgataagcagcgattgaaggataaagtaacccatctcgatccgcctattatgagtaaggtcgataaagcgataaagataagcttgggattagctaaaggctagtgacggaccgcaatacataaaacatcacacaacgcttagatcaattgaatacaattataatcaaaagggagtgcgacgcgaggcgtcttgatcccagaatttaagccaagaagcgagttattcctgtcatggaatgactcgcttcttggcttaaacggccgggatcagccgatagttccatgtttgaactagataacattggaacgcaagcgaggccaagacacaacctccaattagttgtgtcccagcctcttcttttgatatgcacgtacaatgtgcctaatttttttcttcttgcagattttcaacttcaggcactctgaattccttgcgttccaaagcagcaataattctgtttaaacgatcctgatccacttcggcaggcagggtgaacataatgcgatgaaccaattcaccttcttgagcgtccaaggaaatgacgctggcaatgttggtgtacttggtgataattttggcaatttcttcaagatcaccacgctcgccgcttgcaacgacggttaacacgtaactgccaatattcacgttccaagactgtgacagcatgtccaagagacgggtatgggttaagatcccataaaagttatttcgttcgtccaaaaccgcgatgtaggggagatccttaattgaaaagaatacttgaaagaacgcagaattcacgttgatgaacttggttgcgttctttaaaagtgtggtaacgggaagtgacatgtcaccaccccgtgatttatgacgataaatgtgcattttgtagatattgccacggaaaatcttgccggtttcatctaagattggcacacaacgataaccggaatcttcgagagtctgtaaagcctcttccaaggtggcgtcttctttgacggtcaccagtcgttccttaggctttactaatgtttttaatagcatgtttaattcctccaaattaacctgtatacaaccatgataacatagagaaatttagaaaagaacatttaaacttgaattattctcattaatctctaaataaattagaatagctattgaaaatccggcttgaatcagctgacaagctggacacaaggaaatgttccatatgttgacttgctaggacttcctaaaaaaacgggcaattattcctatgggatagaaataattgcccgttttgattcattattgaggctgaggatgctgattcatcatccctttatcgttagtacaaacagcggaattaaagttctgccatgccatcagcagtcgtcttttgaagggtctcagcagaagccttcattgcggcagcttcatcggcgttaagtggaacttcaacaactttttgaatgccggatgcattgaccacggcaggtgaaccgatgtagacatcatgaagtccgtattcgccatccattggcgcaccaacgggcagaactgcattttcatcacgcaaaatagctcgtgaaattctcatcaaacaggtggcaactccatagaatgtggcaccttttcggttgatgatctcgtatgccttatgacgaacctggtcttcaatctcttttaagtcatccattgataaaccggcttctttggcaacgtctaagaatggacggccgccgatttgagctgcagaataggcagcaaattcggaatcaccgtgttcacctaaaatgtaagcactgattgattgtgggctaacttgcaactttttgcccaaagcgacctgcaatctggaagtatccagagaagttccgcttccaaagacacggttctttgggaagccggagaatttttgagctgcataagttaaaatgtcaaccgggttggcagcaacaacaatgacgccgttgaatccagagccaacaagtggatcaatgatagatttcatgatcttgaggttcttattaaccagatccaagcgagtttcgccaggcttttgtggagcgccggcagtgatgactgccaagtcggcatccttacaatctgcataatcacctgagtaaacgtgttttggggaggtgaaggcttgggcatcttcaaggtcgagtgcgtctccttcagttcgttccttaatcacatctacgatcacaaactcttcagcgaggccttgttgcatcattgcataggcatatgatgaacctacggcaccgtcaccaattaaagctactttttggcgttgtaaagtcaaaaaaatcatctccaaatcattaatatataattcctagaacacgctaattatagcatgattttgaaggcgtcttcactgataaacatcttttaattttccggtttttccaggacttaaaagcttgtctgatatgatataatctttatgttaattaatttttcgacagctgaacagtctttgttcagcattttgtgttggaagaaacgtgaggaagaatttaaacaatgaaaatgatcgttggactaggaaatattggcccgcaatatgatgggaccagacataataccggctttatggtagtggaacaatttgccaaaagccatgacatttcaattaagacgcgtaaaatgaacgccaagtatggctctgggtttgtcaacaacaccaaagtgatggtggtcgagccgacaacattcatgaatgactccggcttggctgtccgccccttaatggactactttgacgtttcaatcgaagatctcatcattgtgcatgatgacatggatctgccggttggcaagattcgcattaaggataaaggttcagctggcggtcataatgggattaaaagcattattgccagtgtcggcacccaaaatttcgatcggattcgggttggaattgatcacccggatcatggcaatacggtcgttaattacgtgctgggccgattcagcaaagatcaagccccaatgtttaagcaggctgctgatcacgccgtgaatgccttggatgattggattgacgggatgtcgattccggatttggaaaatcagtataattaacgaaaggacattattttgaagttagatcaattactaacaacaattcctcagtatcaggagttggtcgcaaccttgaaaccgggcacgcgtcaattggtgaccggagtcggcggttccgcccggacacttttaatcgataatttaattcattcgactgacaaaccaactgttgtggtagttgactcgttatttcatgctgaccagttggtgaatgacttatctaacttgattgatgacgatcagttgtttgagttcccggtggaagaaatgggagcagctgagctggccaccagttcaccggaatacaaagcccaacgggtattagcgttggacaagcttgccagcggcgatccggcggtcattgtgacctctgtttccggtattagaagactggtgccggagaaaaagcagtttcaagccgctaagttaacgcttgaaatggacggcacctatgacctggagcaattaaagcttcagcttcatcaaatggggtacgtttttcaaaaaatggttgcggctccgggagatttttcaattcgggggtcgattctcgatattttcccattaaaccatcaagacccggttcgaattgacttttttgacacggatgtcgactcaatgcggacattcgatgtttccaatcagcgaagcatcaaaaacatcaagtcaatcacggtactaccagccacggacttattaatgaccgatgaccagcgaaaagccgtcagcaagcagctgtccaaacggttaattgctgaacaaagtcaactggatgacaaggcggccaaaaagcttcagggcaacttggaaccgcaaatcatggatctgcaaaatgggttgagtgatccacgctggttgttatttgcggatatgatttataaaaaacagtcttccctgctggattacctggctgccgatggcgttgttattttcgacgattatgccagaattactgaaactgccagacagcttgagagcgatgacgatgagtggttgaacgacaagattaagcactatgaggttttgaagtcgaccacatacaccaatgatttcaagaaagccttcagcgctaatcatcacgccaccttaattctgtcactgttccaaaaagggatgggccggatgcgactggatgccattgaagacattaccgtacggccgatgcagcagttcttctcccaaattccaatgcttcgaaccgagattttgcgctggcagaaaatgaagcagacagtcatcattatggttcaagatgagaaacgactggcaaaggtcgcttcaacgctgaacgattttgaaattacggcgactcagactgataaggatcatcttttaaaacaagaagtccagctcatttccagcaacttggacaacggatttgagctgccgttggccagttgtgtggtgatcactgaaaaagaaatgtttggcacggtgactaaaaaacgcccccgccaaaccacctttaacaacgctgaaagaatcaagagttataccgatttgaagcccggcgattatgtcgtccacgtcaaccatggaatcggccgttatgaaggcatgaagaccatggaagtcgacggtaagcaccaggattatttgacgatttcctataaagataacgccaaattgttcatcccggtcacccagttaaatttaattcaaaaatatgtttcctccgaagataagcacccgcggatcaataaactaggcggcagcgagtgggcaaagaccaaggccaaagttgcttccaagattgaagacatcgctgatgaactaatcgatttatacgccaaaagaagcgcagaaaagggttacgcctatcctcaagacgattcgttgcaggcagaattcgaagctgcctttccttacagtgaaacacccgatcaactgcggagtgcgactgaaattaagcgggatatggaaacccagcatccaatggatcgtttactggttggagatgttggttacggtaagaccgaggttgctttgagagctgctttcaaagcaattgaagttggtaaacaggtcgcttttttggtgccaaccacaattttagcccagcagcattatgaaaccatgctggaccgttttcgagagtacccgattacagtcagagtgctttccagatttcagaccgccaaacaagtcaaggagaccctccaaggcttaaaagacggtaaggtcgatgtggttgtcggcactcatcgactgctttcaaaagacgttaagtttaatgatttgggcctgttgatcattgatgaagagcagcggtttggcgttaaacacaaggaacgcatcaaggaaatgcgttctgacgttgatgtcttgacactgacggcaacaccaattccacggacgctgaacatgtcgatgatgggggttcgtgatttgtctgtgattgagacgccgccatccaaccgttatcccattcagacttatgtgatcgaacaaaatgccggcacgattcgggaggcgattgaacgggaaatgtcgcgtggcggccaggtcttttacctccacaatcgggtttctgatattgaaaagacggttgaacaaatcagtgccttggtcccttcagccagagtcggttacattcacggacaaatgtccgaaaaccagatggaagacattttgtatgatttcataaatggtgaatatgatgttttggtaactaccacgattattgaaaccggggtggatattccaaacgttaatacgctatttgttgagaatgctgatcgaatgggcctctctcagctttatcaactgcgggggcggattggccgcagcagccgagtggcctatgcttattttatgtacaaaccaaataaggtcctcacagaaattggtgagaaacggttggaggcaattcgtgactttaccgaattgggatccggattcaagattgcgatgcgggacctatcaatccgtggagcaggtaacctgctcggtaagcagcagcacgggtttgttgattcggttgggtacgacctgtatacccagatgttgtcggatgccgttgccaaaaaacgcggcaagaactttgagtatcgaactgatgcaactattgagcttgacctggaagcctatctgccgagtgattatattcaggacaatcaacaaaagattgaattgtataaacggatccgccaaattgaaaatgaagatcagctccacgaagttgaagatgatctaatcgatcgatttggggactatggtgaacccgtcgccaacctgttaaagatctctcagctgaagatgttctccgattatgcgttggttgataaaatccatcaaaatcagcccaaaattaccatcacgttttcacctcgggcagggacagagttctccagcaaggaattgttggaagcgattgcccaaaccaagttccgggcaaccattaacaccgaaaatgacaggtatcaaattcaattaactgttcagcccaacatgacaaagtggttggacgggctgattgcattagtcaaacaactatcaaaaacccggcatcatcatggtgctgccggtaaggtaaagtctgatgaaaaataggtcaagaagacaactcgttcttaaaggaaccttactgctgacggtcgcgtcatttgttgccaaattgttaagtgccgtgtatcgaattcccttccaaaacatggttggtaacatcggcttttatgtttatcaacagatttatccaatttatggtattgggatgacctttgctttgacggggctaccggtttttatttccaaattagtggtcgacaccaaagatccaagagatcaggtcgggttggccattcgaattcaaaacatcctaatcgtggtttgcctggtggctttttgtatattgcaatttgctgccggattcattgccgggaaaatggatgatccccaattggcaccggtggttcaatcagtcagctggatgttcctgtttgtcccatttctgtcaacctggcggggatactttcaaggcaaaatggaaatgcggccgacggcgtattcgcaagtgattgaacaggttgttcgagtatcgagtattcttttggttggttactgggccttcaaatcgacggtcagtccgtatcgaatgggtcagttggccatgctgtccgcaccaattgccggcctgattgccctgttgttcatcctgatttggatgaaatcaagatcattgccaacaaactggcgaaatcgacgtccgactattgaaacacggctgttaattaagcgcattttgctggagggcggcacactgtgcttggtatcggcagtgatgctattgcttcagttggctgattcattttccgttgtgtctggattgcgatcgtttggctattcgctggttgctgcccagaatatcaagggaatttacgatcgttctcagacccttgttcaactgggacaagttttgagcattgcgtctgcaaccgccgttttgcctggtttggtgttggcaaataaacaccgtcaagatgtcacgtttcaacacgttgcggccacgaacctgagaactaatttggctgtttcccttgccatgagtgtcgggttggccgctctaatgccccaaattaaccggttgttatttgcttcgtccgagttaaatttgacgattagcttgtactgcatcagcatcgttttaaccagcgtgttgatgacctataacgtgattttacagagcaaggataattatttgaggacaatgatcgccattcttgctggctttttgatcaaggtgttggttaatcaattgttcgtggcacactttggaatcattggcgctagtcttgcaaccctgttaagcttaatggtaatggtgttattaatgaacctgctcagtcgaaaagagttggccaaattgatttcttttaagcagcttggcaagcttgtgattgtgctggtgaccatgttcattgcggttcgggcaacggtatttgggattaacctggctgacttggctgataatccaagaatcgctgctttgctggttgtctgcatcgccattccgattggcgtgatcatattttttgcggggtgtcgactgttggacgtatttactgtccgtgaatggttggccattccgtttgttggtaagttcttaaaaattaaaggagtcacaactcatgagaatcgataagtttttaaaagtttccagaattattaagcgccgttctgttgccaaagagattgccgacaagggccggatctttatcaacgggcgggccgccaaatcttcaaccgaagttaaacccaacgatgaggttgtcatcaaatttggtaacaagactctgactatcttggtcaaggaactgttggatacaaccaaaaaggatgatgcagaacggatgtatgagattacctccgaggactatgaacgcgactttcgcaacgaataaataaatatccataaaaatcccgaaaacatgtggaatcacctagacaaatgcccatagattggtataatttatctagaacgtgcgaatgatcgggggatttagcatgacgcagcaaagtgggaaagtacggaagctcgacaacgattttactcgtcgccgagagattgaattgaataactcaagggtgactgctgttttgtctaatcgacgaaaaaagcgggccttagttattagtgccattttcctattctttgcgtcaatttttcttatccaaattgttcgtgccaaagtgaattacgctgacgtgcatgttcgaattgcccgtgagcaaaagaccttaaaacagcaaaaggcggaccagaaacaactcaaaacgcaagtcgcccagttgaatgacaagaattacgtggaacaaattattcgtgatcgttattactatacaaaacctggcgaaacagtctatagtttccctaataaggcaccaaaagatgttaatgattacgatgtcaaataagatgagtcaaggaggccgaggccaaaagtatttgtacttttgtcttcgccttttattttgacaatcgctagtcgagataaaataaaatatgatatactggtaacactattacatgggaggaacatttttttagatggcaattgaagttggagaaaaagttaacggtaaagtttccggaattacgaattttggtgcatttattgatttaggtgatcatcgaaccggtttggttcatatcagcgaagtttctgacggatttgttaaagatattcatgatgttttgaaggtcggcgatgatgtcacggtaaaggtcctcaagattgagggcaacaacaagattagtctttcgatccgcaaagcttctgacaatcatgaacatgaagattctaagaatgaaaatcattctcacagaaatttccacgagaataaccacgaaattcatgagaaccacgggaatcatcaaagtcacggttatcattcccgtggcggcagttctgctcacaacaatcactcgaataatcatgaagagagttttgatgacatgatgtccggctttttgaaagaaagtcaagatcgcttgtccacactgcgtaagaacaccgaaggcaaacgtggtggtcgcggcggccggcgtagttaatcgattagaatttgacaattaataagtttgtggctggggcaatcatttgctgccggccatatttgttttatacctgcaagtcataagcggaggccacagtggatttacagaaacaatttaatttcattgttaagcaaaaagcgtggtggcaggctggagatgcagtggtggttgccgtttccaccggagtggattcgatgacgttactatatatgctgcagcacctgccgcgagctgttcggcccaaaattattgtcgcctatgtggatcatcagctccgagatcaaagcgttgaagagacccgctatatatcgaattattgcagtgaacacgggcttttactcaaacaagctgtctggccgaaagacgaccacccaaaggtcgggattgaggcggcagcccggacctttcggtatcgcttttttgagcgtgttttgaaggaaaccggtagtacctgcctgttgacggctcatcatggcgatgatctggttgaaaccgtcattatgaagctggtccgcggcggtcaattagcttctctgaccggcattcgcgaaacccgatcgtttgcagatgccaacatgattagaccacttttgtcgtttagtaagcagcagttggaatcatttgctcaaacaactggaatcaggtggtttgaagacgaaaccaatcagcagctggctgttgaacgtaatcgaattcgccatggcgtgatgccattactcaaagcagagaatccgcagctgctgcctcatgtgctcagttataccaaccagttggccgacaacttggccgccattgaattcttgattcagccgctgattcattccgcagttggttttccagaaaagcaacgggcagaaattgatctcgattcactcaaagattttcccgacagtgtcgtcaagtgtttgcttgaggaagtgttcgaacattatcttcgaatccccaacgtttcagttgatcaacttgacgaagttttgggcctgatccagcagaccgccagaccacaagccaaaatggatttagaggctggatggcaggtcaggcgggtgtatcaatcactaataatttgtaaggaaccacaaaaaatcgttggtaaacctgaaaaagatcgaacttttatggtaatattagacagatggtattctctgagtccgtccaccaaatttggtgtgttcactgcacacaaaacggttgctaacagtaaactgacaactttttacctgcaggatacagatttaccgttgcaggttcgctctccaaaagcaggggatcgattatcaatcggtcacggacaacaccaaaaggtcagccgggtgctgatcaatgccaaagttcccaacgaccaacgtgagcggaccttgttgctggtcgatgccagaggtaccgtattatcagtgttgggtctgaaaaatgccgttgtttctcgggattccgaggacacgaggccttattttttaattgaagtccgacaaaaataatgattggaaagaaaaggaatttgtaatgaataacgacatcttaaaggtactttacagcaaggaagaaattcaagcagccgttgaaaggctgggaaaagaaatagctcagacttatgcaggcaagacgccggtggtagtgggtgtcttaaagggcgctattttcttcatgaccgacattgcccgagcagttgattcatacatgcaaatcgactttatcgacgtttccagttatcatggtgcgactgaatcttccgggacggtggaattgctgcaggatatcaacaccgacattgatgggcgtgatgtcttaattgttgaagacatcgtcgatactggccggacgttgaagttcctgctggacacgttcgccgatcgtggtgccagttcaattaaggtttgtaccctgttggacaaacccgctggaagagccgttgatgccgagtcggatttcattggttttaaggttcccaacgaatttgtcgtcggctacggtttggattacgacgaaaagtatcgtaacctgccgtacattggtgtcttgaagcctgaaatttatacaaacaattaatagtcaaaaaaggtcaagtgtgttagtattttgactatcaacatgaaaatatttagttttgaggaggacgttgatgaactcgaatagaaatgggctttttaaaaatagtctgttttacattgtcatatctctgctgataatgggggttatctatttctttaacggaaataccaaccagaccacatcgcaggaaatccaatcaagccagtttgttaagaacttgaaggatgacaaagtaaaaagcttttcagtacagccaagtggcggtgtctataaggtaactggaacttatagacagggtcagaaggtacaggtgcaatccggactcattggtggaaaccagactcagtctaagaatgttaccaaatttaccgcaactgtcctcgagaataactcctcaattgctgaaatcaccaaggcagctcaatctaacaatgttaagatgaatgccaagcctgaagagtcaagcggtttttgggtaaatctattggtttacgtcttgccgctgttattgtttgtttggttcttctacatgatgatgggccgtgctggcggtcaaggcggcggaaacggcaaagtgatgagctttggcaaatccaaggccaaaccagccgacagtaagcaaaataaggttcgtttctcagatgttgctggtgaagaggaagaaaaacaagagctggtcgaagttgttgaattcctgaaagatccaaggaaatttacaactttgggggctaccatcccacatggggtgttacttgagggacctcctggtactggtaaaactttgcttgccaaagcggtggccggtgaagccggagtgccgttctactcaatttccggttctgatttcgttgaaatgttcgtaggtgttggtgccagccgtgttcgtgacttgtttgatcaagccaagaaggctgctcccgccatcatcttcatcgatgaaattgatgccgtcggtcgtcgtcgtggcgccggcatgggtgggggccatgatgaacgtgagcagacccttaaccaattactggttgaaatggatggattcagtggcaatgaaggcgtgattgtcattgccgcaaccaaccgtgccgatgttttggatcccgccttgactcgtccaggtcgttttgaccggaagatcttggttggacgtccagatattaacggtcgtgaagcaattctgaaagtccattctaaaaacaagccattggcaaacgacgttgatctgcacgagattgccaagcaaacgccaggattcgttggtgccgatttggccaacctgctgaatgaagcggccttgctggctgctcgtcgcaacaagacgcaaatcgacgcgagtgacttggacgaggccgaagatcgtgtgatcgccggtcctgccaaacggaatcgggttatttcaaaagaggaacgggaaatcgttgcttatcacgaagccggccatactgtggttgggttggtcttgaatgatgcccgagttgtccacaaggttaccattgtaccccgtggccgtgccggtggttatgcgattatgctgccgcgtgaagaccagcagttgatgtctaagaaggacgcgatggaacagattgccggtttgatgggtggtcgtgctgccgaagaaattgtctttgactcacaatcctctggtgcttccaatgactttgaacaggcaaccaacatcgctcgagccatggttactcagtatggaatgagcaaacgacttggtccggtacagcttgaaaatcctgcccaagacacttatggtccaagatattctcaagaaaccggtgctgctgttgatgaagaggttcgtcgtttaaccaacgaagctcacgacactgctaagaagattatcgaggagcatcgtgataagcacaagctgattgcggaagccttgttgaagtatgaaacccttgatgagaagcagattctttcactttggcacacaggtaaaatgcctgaaagttccgatacaagtgaatttccaagtgagcgtgcggcaacctttgaagaagccaaacgtgaattggaacgtaaggaagctgaacgtcaagctgaattggaaaagggtcatacaactggggatcaaactcaagacactgaccaaaacaattcggatgatcaaagcacggatgactctgaaaaaccagatgacgtctctaacaatggtcaaccaaaagataacaatcatgacaatgacgataacaattagttgaatatttcaaaaatgagtttagggtagaattatctctaaactcgtttttattttttagaagaggtgcaagatatggatgattatttagttaaagcaacaacgaccgatggcatgtttcgggcatacgctgtgaatgccaagcaacttgtaacgactgcccagcaagaccacgatacctggagtgcatcatctgcagctttgggacggacattagtcggcacagttatgcttgctgaatcggttgaaaaaaatggtgaagctgtgacggttaaaatcaatggtcaaggaccagttggccaaatcgtcgctgatagtgattcgaacggccatgtcaaaggctatattcaaaaccctcatgtgcatttaccacttaatgcccatcataaaattgatgttggcaaggcggttggtgtcaacggcttaattgaggtgagtcgtgctgccgaaggtgaggatccctatactggaagcgtgccgctggcttcaggtgagattggcgacgatttcacgtactacctcgcccaatctgaacagattccatcagcggtgggggtctctgtgtttgtcaacgatgataattcaatcggcgcagccggcggctacctcgtgcaggtattgccggatgcaactgatgacacgattaatcaagtcatcgaccgaattaaacagatgccgatgatttctgagcttttattggacaatcaaagtcctgaagatattttggaactcatttttggcaaaggtcagttgcattttttggaaactgttccggtggaattcttctgcaactgctcgaagaatcggtttggccgagatcttgagggcctccccgtcccccaattggaaacgatgctcaaagaggataaaggaattgacgtgacttgcaacttctgcgaaagcaagtaccattttaatgaagaagagctggggaaaatcatcaaagtcgctaaagctgagggacaccattaaagttggctgtcgtttttcacaaatatgtgataatatagcaagcggaatttcacaattgcaaacgaattttgaggtgaaagtatgaaatggaatattggtaatgtcacaatccctaatcaggtggttgttgcaccaatggcaggggttacaaattctgcctttagaattatctgtaaagaatatggggcaggcctagttgtttgtgaaatgatttctgaccgcgggattatgtacaaaaacaaaaaaacgttggatatgatgtttgttgatccccgcgaacacccgatgagtatccaaatttttggcggaaccaaggaaacgttggttcaggccgctaaatttgtcgatcaaaatactgctgccgatatcattgatatcaacatgggatgccctgtgaataaggttgtcaaaactgatgccggtgctcgttggctgctggacccaaagaaagtctacgagatggtttcttatgtaactgatgccgttaaaaagccggtgaccgttaagatgagaaccggttgggatgaagatcatatttatgcggttgagaacgctttagcggctgaaagagccggtgcttcagctttggcgatgcatgggcgaacccggaaacaaatgtatgaggggcatgcggactggggcattttgaagcaggttgcgcaggagattcacatcccatttatgggaaatggcgatgtcagaacaccgcaagatgccaaaaagatgttaactgaagttggcaccgatgctgttatgatgggccgtgcggtcgaaggtaatccgtggatcttaaagcagacgcagcattatttggaaaccggcgagctgttagctgagccgacacctgaggaaaaggtggttactgccaaggaacatttgcatcgtttggtagaattgaaaggtgattatatcggttcccacgaatttcgcggtcaagccggctattacttaaagggaattcctcattcagctcgaaccaaggttgccttgacgaacgcatccggcgaatcagcgatggatgatatttttgatgaatttttggagaaaaacgaacagcgaaaagcacgtcagcaccggatagcacaataaattcggcgctttttgtgttatgattattaatagtaaattttcatttaggaggtttcacagtggccaaagacaaagaaatgaatgaccaaatgatcgtccgtcgccagaagatggacgaattacgcaaggaaggaatcgatccatttggacatcgattcgtgcgtacatatcttgctgaacaactgcatcatgattttgatgatgaagataaagatgaattaatggaaaaggacaagaaagttaccattgccggcagaatgattgctaagcggggtaaaggtaaggtcggttttgccgatttaaaggatcgaactggaaaaatccagatatatgttcgtaaggatattgtcggtgatgacatttaccatatttttaaacgatccgacattggtgatcacctcggaatttccggccaaattatcaaaacagacatgggtgaactgactgttcgtgcagagtcagttactttcctgtcaaaggcgctgcggccgctaccagataaatttcatggcttaaaggacaaggaacagcgttatcgtcagcgctaccttgatctcatttccaaccaggacagcttcgatcgttttgttaagcgcacgaagattgtttctgctgtccgtaagtatttggattcaaacgattatcaagaagtagaaaccccagttctgcataattctgcgggtggtgcgaatgcccgtccctttattacccatcacaatgctttgaatatcgacttgtatttaagaattgcgcttgaactgcatttgaagcgattgattgtgggtggactggaacgggtctatgaaattggccgggtcttcagaaatgaaggaatggatacccgtcataatccggagttcacgatgcttgaatcctatgttgcctattatgacttccatgatgtgatggatgaaactgagggcatctttaaggcagcagcagctgctgttacggatgataatgttgtgacttatcaaggccacaccgttgacttgaacaaaccgtttaaacgacagcatatggttgatgcaattaaggaatataccggaattgatttttggcaaccaatgtctgatgatgacgctaaaaaattggctgatgaacaccatattcattacgaaccatggtggaagaccggccatattattaatgcattttttgaggagctcgttcaacctaagctggagcagccaacatttatttatgggcatccggttgagatttcaccactggccaagaagaaccatgatgatccaagatttaccgatcgttttgagttatacattttgactaacgagttcgccaatgcattttctgaattgaatgacccaattgatcagcgtcaacgatttgaggctcaagttgctgaacgtaaagctggtaacgaagaggctgaaggaattgatgaagactacattgaagcccttgagtatggcatgccgccaacgggtggacttggaatcggcattgatcgactggttatgttattgaccgatgcaccatctattcgtgacgtgattctgttcccaacaatgcgtcccgaggataatacgaataacgattaatttttttaaagcaatccaacttggattgctttttgttttggtgatttttttgaagaagcttcaaactttttagtcgtaaccttcacgtaggccactttgaattgtgattgcaaattaactttcgatttttacttgacgaatcggtgagaatcagatatatttatatatgctgatttgaacggaatacacaacaaagcgtgttaatcaaaaaagtttttgttgactctgagcaataggagaaaacacatgaagaatagtaaaggcattatttatacgttaattggcattgtggtattggttgggattgtctttggcattcacaccctgactggcaacgcatccaattctaagagcgccacgattacggtcggatcacaagggtcagattatgatatttggaatcatattgctgacagtaagcaggctaaaaaattgggcctcaaaattaaggtcaaacaaattaccgatggtgttcagcttaacaatgccaccgctcaaggcagcatcgacgtcaacgcctttcagtcatactcgtacttacaggcatacaatcaggaacatcaaaaggcccagttggccgctttggggacgacatatctggaaccgctcggaatttattctgataaatataagaaggtgaatgagctgccagacggcgccacaattgcgattgccaataatccggcgaacacggctcgggggctgctgttgctgcaaagtgccggcctcatcaagctcgacaaaaattttggtgctttgggaaataccagtgatattgcctcaaatcccaagcatttaaaattcaaagaaattgacgataccacgggtccgcgggttctccacaatttggacgccgtcttaatctcaaacacagttgcactcgaaggccatttgaacgtgttgaaagactcgatcttccatgaaaaaattgacgtcagcaccagaagcaacattaacgtgttggcgacggccaagaagaaccggcataacaaggattaccaaaagttggtgaagctgtatcatgaaccagcgattcagaagtatattaaggataagtatgatggtacgaaggttgaagttcaaaagccgttgtcgtatttgaagtaggctgttaaacgatgatttgaatattgatgaatacaacaagaggagttgctcaagacactgagtaactcctctttcgtaactatattttcattgctaataccgattaaataaatgatgcctacttgaaaaatatgtgtgtccatccagatgcatgtacatccgattatgggaaatgcgtttaatcgtgagtctgtggatcttgtgttgataaccatcgataaaacgtcgagcatgcagcacgtaggtgttgtggcttactttgtgccatttgatatgggtaaataaatcgggcatgccaccgaaatacgtcgtttccaatgattccttagtaatagaaaccttattgtagtaagcatggttgccgtcgtgattactggacttttgttgccatttcccctgtagcgcagttggtgttccggcatgccaggtcgcagcactggttgtacttgtttgataaccgatggcaaataggcagacaaataccatcgtaaggatcattttagtaaatttcaatggaattcttcctttcttcactgcagattaacggtagtaatgttctggcaatccactttttggcgttttcactgttaataagcgatgatttttccattttatccaacagtgggttttgaaaccgccaggtcccattcctttgaatttgtacaggtgatgaccaagatatatgtactttggtgaccaaattgtcggcaaactgacatcagcagtactaccgattgcgtgaattgttgaaataagttcatgctttccaattgccatggtgttgtaattacggaagccgtattgccaaaagacattcgttcgccaatgcccgcgtaaggcagtgggcgttccgtgatgccacttggctgcttgtacagattgatcctgcagaaacgcagctgaagtactaaacgaaaaaattgcaagtaataatgcgatatgttttctaatcatttattctccttttagatttaactataattcttttataagaatagttaacaaattaattatatctctaaattgacctgttgaacaaaaaaattgataaccatccggaattatcggcttggagctgattgcttctaaagtctttcaaaatgatgttgatttgcaaaagcatccccacagagcttaaggcaactttgtggggatgtttttgaaattgattaattaacccagcgaatccacactggcaaggaattcacgtgggggaggtgatcaaatcgttttcggtttaagtagatgacgctttgatcaccatttccggaatggacaacgttcacaggaaccttggcgatagaatccgccacccgaacctcacacaaataccgcccgctttccggcaactgctgcaaacggctggatggattaacgatcgataacccattagtttgggcatgaatcaatttcccagtggtttcgtagggatgacccagtaagcgtgtcgcctcttgaatattgccgtcgcggaccaaatggcgaattcgcgtcgaactgatttttagttggtcactggccaattcgttgacggtgaccgttttgaccttaccgccactgattttggccagtgaatcgatggtcgttgtcccaccacggccaaatgtgtagtcaaagccggcgacaacgactttggcatttaacccaatcacgtattggtctacaaagtgctttggtgataaggccgcgaattgtttggtgaagtcgatgacgtacagaatatccgcgtgggtggcccgcaccagttcaattttctgtttcagggtggttagatatctgaaactggcggtttgactatgattaaacactctggaggcatgtcgattgaaggtcatgaccgctagttgataacccttttggctggcaatttttcgcgcagttgcgatgactttctggtgacctttgtgtacgccgtcaaaaaagcctagcgccaagacaattggggtgggggagctggacatatttgattgagaatgttgattcaagtaaacgactttcatcgctggcactccttactacctacttttctatgtagtgcaaaggccggaaacaaaagcgcttgtttccggcctttgatcttctttcacaacgattatcagttggtttgaagctgatggttctcggcttctttcaagaagtagctcaatggtttcaaatcttgtgcctggtacttcttgacgtattcggcaactttgtccttatcctgccatgaagtgtccaggaacatgtgctgagttgtcaatggcatctcgtgggttaatttaacgtcaatgaccactggtttatcagtgttttcagcatctttgagggctttttgcatatcttccttggtgtgaacggtgtaactgacggcgcccattcccttggtgacttcagcccaattagtgtcaggcaaatcaacaccggataatggctgatgagtatcgtcagtctgctccgcttcgataaagccaagcgtttcgttggtgaagatgatgttgacgatgtgcaggccatatttgacttgggtcatgacttcttccatcagcattgcaaagccgccatcaccgctgaggctgtagacgtcacggtctggatactcaagcttggcagcgattgatgctggcagggcaaagcccatggttgcgtaaatgcctgaggttgcccatttctggtcgtcgtgcatgttgatcagccggtcgaagttgatgtcaacgttgccgacatcaacagcgaagactgctttgttggaggcagtttgattcaagacatcgaagattggttctggacggaccggcatttgatcggaatctttgaagctgtccaaccagctgttccagttttctttatcggcaaggcaagcctgatagaatgctgaaggctgacgggtttcgccggcttcaagaatggcatccaaggcaacttttgaatcggccaacattgaaacatcgttgtgccgacgctcaccgagtttttcactttgaatatcaatttgaatgactttagcgtgtttgttgaacaagaagatgctgaatgggacgttgttgccgacccacagaatcaagtcggtgctgaatccggcctctgaaccggcctttggcgcaacccggccggttgatccaagataggctggatagtcgtctgggagaattcctttggctaagaatgatgaaaccaatggcatcttgaatttttcggaagcttccttcaattcgtcggcagcatccttggcaccaatcccgaagtaaatcattggtgatttagcttctttaattaatttaacggcttcttcaacgtcttctggacgagggcttggatagacaggtgtttgatgcgacttgacgtttggttgatacgtatcgttaatttgagcccagccaaggtcctttggaatcgttaagactgcaacaccgtgtttcatgtaggcttgacggatggcttcgtcagtcattcgcggcaatgcatctgcagtcatggcagtgcggttccaaacagcaacatcatcaaaaatcggctcttcatccattgcttggaagaagtccatgttcatgctgccggttggtacttgcgcaactaaagcaacaacgggaacgccgtcactttttgcgtcatacaggccgttgagcagatgaacagcgcctggaccagctgatccgaaacaaacgccgactttgccagtcaacttggcagttgcggcagcagcgattgcgccagcttcttcatgacgaacctgtacataattaatctgtttcttttggttgtgaatcgcattcatggtcgagtcaaatgagccacctggcaggccgtagatgttcttaacaccccattgttcgagcaccttaagaacagcatctgaaccactaattgtttcaaccataaataaataacccccttaaaaatttttgattcatattttttcctcacttactcgagtatagtgcgtccttaatcaaatgtaaacgctttaaattgaactttataattatttcattttagagaataaatgcggatagaacgcgattcttatttgaaagaaagcggatacagaactataatcgaaaatgtgaggagatgcacaatatggatgcaattagatattattcacgaacggggaatactgaaaaacttgcgaacatgttaggcaatcaattgaagatcgaggcgaaatcgattgatacaccgctgaccggaacggttgaccgactgtatttaggtgggggaatttataacctgaacgtcgatgaacgcttgaaacaatttgcccgcaatctggatccaaagcaggtcaaagaggtctttttgtttggcacatctggcagtctattcacagtgggcaagcaattgaccaagattttggatcaaaagcacatcaaagttgccaaggatcatttgtaccttcatggcttgatgccgaagatgggcaatattaatcagcatcagcaggctgagatcaagggatttgccaaagaaacggttactgaataaggctatggactggcaacttcgaatccttccgcggacagttgcccgccagttaccaggactacctcagactggcggtgacggttggtaggccaaagcgatattaattgttgtcagcctactcaatggattagttggaattggcaaatttatccaacgtaagctcaaaaattaaatcaaatgaatcaataaaggcgattcccacagctagttagctgttgagaaccgcctttctcatttggatgtcaaaatgtcgttaataatacaaatcaatttattcacccggtacgtagtcctggtcaatcaccatgaccggtttgataaccgagccgtcatttgaagcttggttggcttcgttgacttgatcaaaggtgtagaatttttccagcttatcaaatgggaattcgcctgcctgccagaaatcgattaaagtctgaatcccgatttgtggaatcgcatcgcccatcagcacgccgtcaacgtgtttttgcagcgcagtgatttcattccatggcatgaattccaatgtcttggcagtaacggcgattggagccagatgaccgccggatgccaaagcagtgatggcttggtgcataatagctgaaattccagtggtatcaattgcaaagtcaacaccttcaccattggtgatttcatgcactttatcaacccagtcttcgttcagactgttgattgtatcggtagcgccaagttctttagccatttccaaacgtgaatcgtggatatcgacacagatgatctttgagcagcccttaatcttggcagccatcaaagcagcggaacccacagcaccggttccgacaatcgcaatcgttgtgccttctttagggtttaagccgttaaatacggtcccagatccggttacaaagccacagccgagagggcccactttacgtaagtcaatatctttatcgatcaccgtaatgtttcgttcttgaaccaatgtttcggtggtaaatgaggattggttaaagaaattatgaattggtgaaccatcttcacgggtaaaggcgactgatccatcgggacgaacgcccgcaaaattcagcttcccccagttaatacatgaagatgggtgaccggttaagcagtgacgacaagtcccatcgtaatcgtatgagagaatgacgtggtcgccttctttaacggtggtaactgacgaaccaactttttcgacaattccggcaccttcatgacccacaaccccagggtatgcgtagtcgccggcagacccattacgaaccgcttcatcagagtgacaaatcccacttgcaacaatatgcaccaatacttcatgtgcttttggctgatcgtcgacttcaagtgtttccaacttgaacggtgcatttaattcttcgatcaccgcaccagtaatttgtcgtgacataacaaaaactcctttcgaaaataactcgaccgtctctaatcaattcgtgtaagcccttccatacgcgaagaatactacgaattttatgcgcgtacaaggaagataacttattattttatgcacaagccaagttgataatcaaagaatcatacattgtgactttaatcaccctgttgggaaggagtcatcatgcgaacgacggcattaacattgttattagcggcagtctttgtggcagccttctcaatctcagtcgcttttcctttgccgttatccgagagctgaatggcaatcagggaaatcgtgtgattggctttgtcttgaacttggccaacaaaaatattgctgatttgtttgggatattttttgacgatgtcattttggacattggtcaatgaggcattgtcggctgaattggtgttggtttgaattgtgtcattagtgtctgattgcttcatataatcttgaaattctttgggtgtgatgtaatttcctttggtgagctgtgtcaacgataactggtaatcaccgagatgatactgcttcagtgactgctgtagttgctcgacttggctggcagacaagcgttggccgatgaccgagatttgaatatttttgccgtcaacgttttgtttggcaatgtattgattgctgagcttctcgttgataaattgtgataattgcgtgtcgacaaatgaattgtggacgatcgtgtaagctgagattgagctgggaatgacaatgataatcgaaatgatgacgatcagaacttgttggcgcaatgatacattcagccgttcaccgctacggatgcggaaaaagatggtcccggctgccgttgccagggcgatgaaaaaggcgttaatcaaaaataagtagcccgctcccaaaataaatgaagcgttgagatgactaatcccatacccaaccgtacatagcggcggcattaaggccgtggcaatggcaaccccggggacgacgttgccaccatcttttttagcagaactgatgacgccggcaaaaccgccaaaaaaagcaattaaaacgtcccagagagtgggttcggttcgggcgagcagttgggcactggcggtatttaatggcaaaatgaaaaagtaaatggttgcaccgatgatcccgatggttacctggatcaaaaagagtctcgccgcttttgataatagctttggattgctatttcccaagccgtagccgatcccgacaattggcgccattaatggcgagatcagcatcgctccgatgacgacgggcgcggaatcaacgttgaggccgatacaggcaatgatgatggcacagaaaaggattgcttgcgttgaccaggtaaaattcaaatctttttggacattcatatttaaagtttttgtggaaatttgctgcataatcatcacccatttctattagtattccttttttagaatagcataagcaaacgcttctctcatggattttgtcgccggttgttaacttcgatccccggatggttgaagacatggggctgattttttcgtatactatagtatgtgactaattcgaaaagaggactgaacaggttgacgcccgaaaaactattaaaaactaaatttggctatgacagctttcgccctggacagcagaccgtcattaacgacattttggcccatcaaaacgtcttgaccatcatgccgaccggcggcgggaaatcgctgtgttatcagattccggcaatgttagaagatggcctgaccctcgtggtttcgccactgattgccttgatgaaagaccaagtagacgcgctgaacgaaacgggcattccggcaacgtttattaacagtagcctggattttgacgaaatcgacgagcgctttcagcaggctcgagacggtgaggttaagctgctgtatgtttctcctgaacgcttggattccggggcgtttaaccgcttggccaacctgccgattgatttggtagcggtcgacgaagcccactgtatttctcaatgggggcacgactttcggccaagttatttggcattgaccgaacggcttcatgacttgccaaccaagccgacgatcgttgcgctgacggcgacggcaacaccgcaagttgccgacgacattaagcagcgtctgcacattaaagaagaagtcaagacgggttttgcccgagacaacttggcttttaaagtgattcagaaccaagacagcgacaaatatatgctggattatttgaaattaaacgccgctgaatccggcatcatctatgccagcaccagaaaagaagttgagcgggtcacgaagcttttgtccaagcacaaattctcggtgactatgtatcacggcggcatgaccaaggagcaacgccgaaaaaatcaggacgattttctttatgatcgcgccttggtgatggtcgctaccaacgcctttggaatggggattgacaagagcaacgttcggttcgtaattcatgattcggttcctggtagtttggaagaatattaccaggaagctggtcgggctggtcgagacggattgcccagtgaagcgattttgctgttcaaattaaaagacgttcagactcagcatttctttattgatcaatctgaacgtgacgagcaaagtaagcatcaagcctacaaaaaacttcagattatgacgcagtatgccaatactcagcaatgcctgcagcagtttattttgaactattttggtgagaaggacggccaaccctgcggccgctgcagcaactgtcttgatacccgcgaatcccaggatattaccgtggacacccagaaggttttatcgtgtgttcttcggatgaaggaacggttcggtaaaagcctagtggctcaagtactgaccggctccaaagtgcaaaaggtgaaagcttttcatttcaatcagctctccacgtacggcattatgaagggtgattcgcagaaaaatgtggtttcattaatcgactacctgaccgccgggggttacctggtggcttccggtggccaattccccgtgttaaaggtgactgccaaaggtgccgccgtgctccaaggtgagacgaaggtcactcgaaaaatctcggttaaggccactaagagtgtcgctgaaaatgacgatttatttgaagccttgagacaactccgccgtgaattggctgagaagcagggagtaccaccatttgtcatcttctctgataagacgcttcatgaaatgagtgccgtgatgccgacgactgactcacagatgctggatgttaagggtgttggcgagagcaagctggagaaatacggtgagcagtttatggacgtgattttgaattatcaagctgaaccgaaagttgggaccgaagtttgatggtacccgcagatgattgatatcagctaaatcattaaattttataagaaatgggccttcacctgaattttgaaattcggatgaaggcccatttttaattagtcaattagcacctgttttacccaaggaccccactttctatgagcacataaaccccaatcgcgatgaaaattatcgggatcaggatttgctttgagtgctccaatttatccttgatgatcggcaggttagcgatttgatagccgatataacaccaaaggcctgtcatcagcgagaagaccaaaacggtgattcccaactcggccacggtatattccgtgaagaggggaatatagacggttaggttcccggcaccgttggagattgttattaatgaaacggctaaaatctctggcttgaatagttttcgcaacccagatttgtgccgttcaactttcagctcttggttgagcttggttttaacgtgagctgtctcatgagtttcgatcaattgatgtcgatactgaagccatttgcggatccctaaaacaattgggaccactccgagccagccgacttgttctgttggcagaaaactgagcccatatgccgccaacacgctgaccagcactaaaatttcaaatccaatgaattggccgataacgatatctcggcgcctcaaagaagcatcaacttgtgaaaaccagactgccaggacaaaggtatcgtcgatgttggtcccaataaatgagaggatgctggtcataatcgttgtgagcatgggttcacctccgaatgactgctgttagtatcagtataactgattcattgaggtgaaagtgataatgggtgtttttaatgaccccagtgacacgttgaatgcaattgttttgaactctccgatcctcaacaaaaaaagtcgtcagagccaaaatttttcctgcatagtgttataaatgatactgaaagctagaggaggggtattatggctgataacacgacaagcaggggaaagaattattcaattattgcggtgttggggatgttctcatttctaacggccttgtccggctccagtacgaacctggcgatccctaaaattgcgattgacatggacatttccagtagtatggcgacgtggatcgttcaaatcggtttgattacgacagccattctgttggtgatgtttggccacatcggcgacatcttatcaaaaaatgtggtctttttagctggggggattggcttcttgatcgggtcggcgattaccggctttgcgccgaactttccgattattttatttggccgggtgattcaagcgattggatcggcgatgattatggccaactcaatggggattgtcactcagtattttcctgataaacggcgggcagaagctttagccgtcatttcgatgttcatttcggttggctcaatttccgggcccgggattggcggcctgattatttcagcttccagctggcggtggatctattggattaacgttcctttggggattgtcattctatggcttggtttcaagtttttgccgattcccaaagaatcttgggcgcatgttcgccgggtcactcagggcgccaactggaccgggcagaatttatttacccttggaatcattatcttcttcttgagcggttcattctttcaagccggccgttccaaactattgacggggattatcttcttcgccgttggcggggttattgcactgtatgcgtttattcaagatgataaggccaacctgccgtggattgcgccggaagtcattcataaccggggcttcatgacgtcgattacagcattggcgctggttatgctggttaattcagtttcaaacattttactgccattttattttcaaagttataacggcatgagtgccttttacagcgggctgattatcatgttgcagtcggtgacgatgctttgcacgacgccatttgccggctatcttgccgaccggatcaaccgggagttaatgaccgttgtcgggttgttgattttgatgatttctcaagtcggttacgcattcttcccgaataacttggatatgtggaaaattatcccaccgatcatcttaaacgggattggcatggatatcttcctgtcgcccaacaacgctttaacgatgggattggttgacaaatcactctccgggattgccggatcattgaattcgtttgcccgaaccttggggatgacaattgggattagctttgggtcatctttgctgttcttccagctgccaggggttaaacgagtcacggccagtgtcggcttaccatttattcatgcatttgccaacgtcttttggacagcaaccgtcatttccgcggtggcattagtgatcgttttggttcgttacctcggatcgcgcagaaaaccggcagctgctaaggaatctgcttagaaggggaggctgtcacatggcacgttcaaagatcaaaccactgagttttttgagcgtctttttactgggtgttgacggaattgtcggctcagggatctttttgatgcccagccgggtgtacgccaaagtcggtgacttaagcgccggattgatgatgctggcaggcatctcggtgctcatgattgcgctgtgtttcgccaacctggccagcaaaattcctggggatggtggtgcttggctgtacacttacacggcctttggtcgctttgccggatttgaaattggtatttttacgtggctattgggtgttattaccatggccactgaaatctcagcatttgtaaccagcctgcgcagtgtgtttcccagcctcaaccagcatggcaattatctgatggcggcactgggaattttggcagtcttgacgattcttaacttgtttggacccagtttgatggattgggtcgataatatctcgacggtcgccaagattggtgttttggtcctttttgtcgggatggggctgttctttattcatccggcaaattacgccaatgtgagtgctgggatgtcaaacggttcgtcattattcggtcgaattaataccggctttggaatggtcttttatatgttcactggtttttcatttttgccgatcgctgcttccaagatggatcatcccgaaaagacacttcctaaagcgctgatcagcgtgctgttgacgtcggcaactttgtacatgattgtccagttgacggcgattggcgtgtctggcagtagtttagccaacgacaacgtgccgattgccgcatctttttaccgcttggccggcacagttgggtatgatttggcactggtcggaatgctgatttccattctgggtgttgccttgtcggtctcattttcgacgccgacgattgccagttcactggcgtcggaacaccaattgctgccgcgagtgctgggcaggcagaataaacgcggtgtgccaatcgtgtccttgttgctgtcctgcgggctttgtgcattgatgctattttcaggaaattatttgttcttagcctcagctatcgtatttacgtcatttgtgcagtatgtcccaaccattttagcggcgattaaattgcgcaaccacaccaaactgccgctggggttccgactgcgaggtggcaacttgattccgattatcgccttgttggttactgcttatttgattttcagtttctcactggagttgatcattgccggtgtcctggtctttttactgagtgccgtgtggtacttttatgatgaccgagatcgccaggcaaaggggttgcgaagggatattgcggaagtggataaagtattttagtgtggaaaaatcagcgtttagcttccagaatataaaggggagtagccaagcatccaggtcttggatgcttggctactcccccttatatggccggaagctgctgatttttccacgattcggcaagggtaatctccagaaaccaaaaagggcccctgagcaaaacatcaaattttgccaagcgcccttaatttctcattcaatccgccgaacggtcccattggcttcattccgccaccccggggcattcaaggttgaaatccccacgccaccagtatctgattgcccgtggtcgtgtaagaatagatggtccccaaggtaaatggcaacgtgcgagttgacctgaccacgtgaattggtgaagaagaacagatcaccgcgtttcatattttgaaatttaaccggacgccccattgtgaccaaggtgtatgtcgtgacgctatccagattgccaagggtgacgccagccttactgaagcagtagcggacaaatgatgaacaatcgaacttgtgatttttgatgtcactcaagttgcgaccgccaccgtaatcgtatttggatttgccgacaagtttgagtccggcatcgatcgcggcctcaattttggggttgttgcctttcagtttgttgaggttccgaaacaccacgctttgtgcgctcacccagtaagtatgtccattttgggcgaaagaaatataaccttcagcgcgccggtgattcagatcggcccgtttttgaccaacaattctccgagtcagatgattggatgtgacggttcctagatattttgatcctttagtgccggctggcgccgagtatagtttggcgtttgagtggataatccgcaggtcataaggatatttgtatgattcaaaaatctgattaggaaagacttcttccttaacagcagtgacggcggttggcgtcttatctggactaagggtggctttgataaaaatcaccccgacaattgcgatcacggctaatagactaatagttatcaataatttgcgatgacgatgtagcataatttccccccgatgattgttaataattttattatgggcatattgaaatgtccatgggccaatcagtcgatagtttatgggtttcttaaccgttttgagcacaacttggccagaaaatgagtaggcgctttcttgacattttagctgaaacttgtacaataagtgccaagtcgagttaaaagtatcttttacttttacttaaaagtagaagatacttttatgataatcaaaatcaaaggagaagattatgaaaacagaaccgattcatcgtaccagtatgtggaaatttaagttaagtgctgccaccatgactttgattcccgctgctgtggggattaactatgttgccaaagcattggctgaggggttaaagctgcctgtctggctggggtctttgggaacttttcttgccagcatgttggctgggccggttgccggtgccatcagtggtttcatcaacaacgtgatctatgggttgaccttatcgccaatttcaaccgtgtatgcgattaccagcatcggaattgggattgctgtcggagttttgcacgccaatgggtggttctcgtcagcacgccgggtatttgtttctgctattattattgccattgtttcagctgtcatttcaacgccactcaatgtcatcttttggggtggtcagaccgggatcgcttggggtgactcattatttgcggtaatggtcgccaatcatgcaccagtgtggttggcctcatttaccgatgagtttgtcttggatattttggacaaagtctgcgtggcttacctggcattctttatctatcgtcagctgccgcagcggatggtgaacttttttagggatgataaatgatgactgatcaaacattgatttctggagcaccacgggtcaagctcaagtggtaccaggtgatcgatccgattactaagctcttgttcatcttggacatgacgttgttgagttttgccagtacgaatttattgcttcaggccggactgattcttgtcgcaacactgctattgttattttccaaattgagttcgaccacatttaaggcactgggattcagcctgtttttgattggtaccatgctgatcatccaagggttgttttacagtcggaatcaaacggtgctgttttctgtgcttggggtgtccttttacaaagaaggcttaatttacgctaccactctcggttgtcgagtattggtgattattttgaccagtggctttttcatgttgaccacgagtatttcagaaaacgctgcctatttggagctgtctggattgtcttataaaaccgtctacgttttgatgtcggtgtgttatattttgccggaaatgatgcgcaatatgcggaaaatccagcaggctcaaaaagttcgcggaaccaatccgcaaaaaacgttgattcagaaattaaagtcagtcctgccggtgctgattccattggtgattaagaccttggatcaatcgatggcacggtcgatttccctccagctcagaggttttgataatcccaaccggactgtcagaacctcccagcgcgtgtatcgcctgtcacggacgttccacattgttttgactggattggcaattttattgattgggtggaagatatggacgaagataaacggattgtaattgaaaatttgaccacccgttatccgggtactgagcaaccacaactgcgtcagattaacgcgcaggttcggtcgggccaggtggttgggattattgggaacagccactccggcaaatcgactttgtgccgtgtgctggcaggggtcattcccaagattgtttcggccgatattgagggcgactggcacatgtttggccagcgagtgtctgataattggcccgcatataatgccatgactggagttgtgctgcaaaatccagctggccaactaagtgggttggcagacacggttgccgatgaaatcgcctttgacttgattaatcagggaatggctgaaggactgattcaaaaacgggttgaagaagttgccacgcaaatggggctgattgaacagttgaatttatctcccgagagcctttccggcggtcagatccagcggttggcgattgccacggcgattgccgctaatccggctgttttgattatggatgatccgaccagtgagatggatccctttggccgccggcaatttttccaatggctgggccaagtcaaagacacgactgtcttcattgtcaccagtgaaattgacgacctgtgcgaagttgccgacgttgtgtgggtgttgaacgagggtcaactggtagctcagggcaggccgggtgaggtgtttaatcatttggcagctgactggcagattccagctccgacaattcagcaacttgctcaaaaaatggattggcacttggctgacggccggtatccggtaaatgacgctgagctaaaggaggcccgatatgtccacaattgaactgaatcacctgacgttcacctatccggaacggtcctttagcttggatgttgaagacgagcacttcgccgatccgatggtggcaattgtcggccaaaatggtgccggcaaatcaacgctcttcaaattgttgacgggattactgacaccacaaaccggtgtgattaagatcgatggagaagactttaacgatctcaaaccagtcgaaaagttacaaaaggttgggattacttttcagaatcctgacgatcagcttttcaacccgacggttcaacgagaggtggagtggagtgtcgcgcaggtcatggatgaccacgacacgattacgaggcgggctttagaagctctgaaaagagttggcttggatgatcaaacagctgaaaattcatatgatctgtcgttgtctgaacgcaagctgttgagcgttgcgacagttttggcagtggatccggcgatctatttatttgatgagccgatgatgtcacttgactgggaaagccggcgcaagttgaccgcaattttccatcagttggctgattcgggccaccaagttgtgaccatcacccatgacatggattgggtcgccgccgagtttgagtcggtgtatgtcatggagcacgggaagtttggcttcgccggcagtccacgggaattgttcagcgatcacgaacttgtccagcgagtgggattactaccaccgcgcattatggccgtagcggagtcgctgggtgattcacggccatatttatccgttaatgattattggcagaaaaatcgagatatatagaaaaagtcacctctgtggggtttccaaggttgaaggatgaacttcagctcatggcaagaactcacatgggtgacttttgtgtctaataacgtttcatgatcatcgggtgcttcctcagatcactaggtttgattttactttgtttcatggtcataatcatataccatttcttttggatcttttgtttgactaatacaaaataggtcttcgaatttttagcgcccattccggtgccaaaaacgacgccggattcttgggtgtctttcttccaagtgacgggcttccagtaaacaccgtcgtttttgacttggagcatgacctcgtttcgacgaatgccaacgtaaacatctttgccattaactgcctgccagttgcccaagtaccaatgtggaatcgacccggccgcgtcaacccgtggattttcagtcaatagtaacaagcatgcacaactggcaaatgccagtaataaccatttcattgttttcatgatatgtatccccctcatatatatttataccacaatcggaattattccaagcatgtaaatttaaattaatttattgcttatagttttcagcatcttacttggatttggcgttttataatcagtcatttagcagtaaactgggaattattataagaaaagagatgaggggatgctcagcgaatttttagttgtttgtccgttggtttttctggctggctttgtggacgcgattggtggtggcggcggtctgatttcattaccagcttatctgatggttgggattccggctcattttgcggttggaaccaacaagttatcatcagccatggggacgacagtcgctaccttggaatttatgcggagcgggtatatccgcgtcaaactggctttcttctctgtgttagctgcgatggtgggttcttcgtttggggccaacatggctttacatatttctgattattattttcggctgattttattgtttgttttgccgataacggcgttgtatctattattgaatcgacactcgctgaactcgcgactggctgagtccaagccattgacttggtcacagtttgtcgcaacgattctgatttccatatcccttggtgtctgggatggcttttacggtccggggaccggaacctttttgattttgacgttggtcggcattgcccacttgccaatcaacctggctgctggtaacaccatggtgatcaacctgacgacaaatgtttgtgccttagcagtctttttgatgaatggtaaggtgttggtttggttagggcttactgccggggcctttagtattttgggtaatttccttggcgcctcatattacaaaaggtatggcagtgcgattgccagaccgattattattattgtgctagttatcttttttgccaaaacggtttggcagtttttgaattaacttcgccaatcaatatgatttggggtatgatggaattaccttggcaggggcacttgatgctcaaaaagcaggcatttatccaaatcgtagtaatatggaaacttatcctccgtagatcgttttaaatcattcaaatgtctaaacgctgctagtttaattgttttgcaggctaactgttgaccagttaatacccggtagcaataaacagtggccggatcacggtatttacttttgatttcatcaaagtagcctttcccatcaagctgctgaaagattttatccaagttagtatttctttgagtaaaatcaaattcctgtaccactaaaactcacttcccccatttaacatctctttaatattgggttcctcatcgttgtcatctgagagttgcagtaatgaggctcgtgcagatggtgttaagcctaattcgtgtgctaagctgtttaattttgccgtagcagaatcaataatttgtgatgccggattacgtttccagcctgcgttgtcttcatatgtttctccagttcgttgattgaccacagttttagaaactttggtgacaacaccatctgtttcaattgagtcatagcctttccgcaataattgatagttaatacaaaacgcttcaattgttcccttgtcggcctgtttaacatatcctgatgcttgcaaaattggtacaagtttcgtccacattgctcgcgcataacttgacagatattttggacaactcttttgaatcaaatccattccagaagtttccgttattagtttttgagttctaactcgctgatccttgcgagcatgcttgtctgtagttagtttcatttgttttggcattttttagttcacctccaagcaataaaaaagagcccccaatagggactctttcaatttgattcatttagactaatgaatcacaaaaaaatcattaaacatactgttcgaacgtatacaccctacaatcgtgaaaaaacatctaattatattaacttttaggaggtaaatatacatagtcattatagtagggttattcatataaacaatttgtgaaattgcgcacccagttatagtaagcccataaaaaagttttgaatttacaacttttaacgtgcgctactcctgggcgtgcgctcccctaggctttcaccaccccgggggtgtttaaacattcacctaaattgtatatttttttgtaagattcaaacagtaagctttaaacaattttttctttatatctatatcacccagaggaggttgaaaaaattgtttttaataagtaaacctcatcagaaatatttattccgattacctacatgataccacctgaaaaacactttgtcgtttcacaaagacatctttttttagttttgttgatgaaaatccccaccatccaagctggcaggagtttcctacatcagggatgtttatttcgtgcgttcagataatactttaatccaccaacgtttgctgcagtgtttgagttggttttgattgagtgattgttcaatcttggttttcgtattatgcgtagtcggtgacaagcaccataagttatccatgtctaaccatttatcaacagatagtacacgtctaggcacaatgtggtcaacaataatcttatcgtttgagactggcaagccagtgactgcatctaaataataatctcgtgcagcaacaaattgccgaatctttttccattcctttgagtgataaaactgattcgctgtttgatcacgatagtacatattgtactctcggtttcgtgcagaactgactgcatggttgggcttctggtgctgtgtaacgtgctcactgcaatacctttgccccattggtatcaatgcttgacagccaacctcatgacagatatgtagcttcatataagctcacctgtccttctttcggtacgaactgtttacttaattcctgctgtaaatcaatgattgaatcaattaatttgtattcatccagtttcaattgatgatcattaattaaaccaaacgatttccaaacaatgccttggtatttcattccatatactttagttgcgtaatcgaatatatcattgaacaagtcgctattgctgataaataaggtgtgaacttcgctgtttaatgtcattggatcagcgtatttattaaggcaatattcaaaatcacctaatacctttagcttatctaacgtatcctgatgatcgaagacacttaactgttcagtaaacatttgtgcatttgatttaacgtaagctatacgatcatacaatgcatgttcaaactttttatcagtcattgaaaaaatatccattgtagctatttttccatatttaagcaggctttttacaaacagtttggttttatcagtcgggaataatgaaataactttattcactaatgaattctcaactgacactgaacttttacaatttataggcgccaattgtccaagttcatcagatttatcaaaattctctaccaataacgtcttgtgaccataataatcttcaaccacatctttagcagcataggtaattgcccattgcttatttttaaattcaggattgctatgatcgctgaatgccttaatcaaggtattagcattgttataattccaaaaatgaattcgtcttaatacttgctcaattaatagactaaaagcatcgtcttttgaacaatgaattgaataatgaatccggttaatgccattttcaaagtttcggctctcagtaattgcttttactaagttttcatttcccattttttcaccgcctttaaacttggtttacatacagctagacattgacgataaggagaaactaattattaacgtttatttcagaaattgtccatccacagatggtttgatgatgctgaacagattcttcaaccatccaggttttgattggcaaaccagtttcggcttttaaaactgcttgaatgctgcgaaactctttcagtttgtgagctttccctcgctttgttatcacatacgtcatataaatttcctcttctaatcacataattttgcatatacttattgtgcacatttaacagctaattggcaagctttcataaaatttcattcctccaacaaaaactaatcgacaattggacggtcactcatttgtatgcttcccgtagcttctctcgcaatttaacgctgttggcgacttaaactttcttctccctcaatcaccacggcagccttaaccttccgctcaccacttatgtgtgtttcatgatagagtttctttagtgaacaacagctatcacttgcagacccattaataaggtcaaccgcagcataattgtctatcgatatttgcacgatcatataaacagaaacatcatcttgaattacatcgcccactgagtactcagtaaccggtgcatgtgaacctttatcaataatttccatcatttgtctgcctccattttgactttaactgcgtccttccaatttttaacggtctcgtcgaggccttttttggttaggttaaactcgccattttcagcaaccaacataaaataatcttcttggatgtaaactgggtattcctcgcctaccttaaaaacacgatgctcagctacaaaagtatactttggaacgaaataacaatagatcttcatttgtctgcctccaataagtccttatcttcatgaatgttaccgataatttcgcagtccataaactcttcacccaaatcgtaggtaactccattaccagttatttcaaattttccttcatcaaaaataactttatatggtgaatcatcaggatcaagctgaacaagatcgccttcgtaaatttccttgccatttgaatctttcaggccggtaaactgttcaacaatgtaagcgtccggattcatttcagcaaaactcaaaatgctacttgcacgtctatgaagcatctcttgcattggttccttgctaccgaacggcatataccatgctctaaatttaatttgtctgttcattaccgtcactcctccacactttgaatgcttgaattatttaacaaatccttcaaaaactcagcttcgtcccgtgtaaattgctgcgtaattccccctcgacaaacgcgcgggttacgaactccacagatgaaatacccaccacgatcatctactcgtcgagatacatactgttgcccatcactaccaaccatgccattcattttcaagcgatacattggtgcagacaatttcactgtttcatgatttaaaattgcatctataacactggctaaatcatcacggttagaaatagtttcatcatcagcatatttatcaatgaatttggcgaatttagctattcgcttccaatcagaaatactttctgccattgcattttggtacattttaaacagttccttatcaagtatttttactgtcattttatttacctccaataattttcaacgcgtcatctacagaacgacaaacaccatataaaactggatattgcttaataaattttgcaaaccgcttctgatcttcacgtaacttgcctcgttcattttttacttcaatcaaaatcatttttccactatgatgttcaaacccggtaatgtccggccaacctctcggaaataacataattcgtctgccatcatcagttttaatctttccagcattactacggcaaacagtacaatcatgtcgcgataatgctaaaagaatttctgtttgaatttcatgttctgatttaatctttatacgcctccaaataattatgacggatgggaggataaatgggaggatgattcagttgctgtatccattgcggctgtaagaacaaagcctgtttttgggtgtatgggaggatcttttcaccaaacctttatatatatctttttttactcttttatcttatatacttttattaatttatcctcccatagtataaaaagagtatataaatgtagttgtatcaagggtttgagcttgaaaatgatcctcccattatcctcccaaaagagcttttatcctcccatttttatttaatccagcctagtcttggatcgtctttaatttttagtccaatataaaatatggatccactttttttagtttcaaatttctgcttcatctcacggctaaatttttgcttactcatagagtattccgaattgtcttttgcccaggattggtatttcttaaaaagttcaccagcaggcgctcggtaactatcacttacctcgcagcaatcatccacgaatagactaataacatccatttcttcacgatattgccgactagcgcgagtaacacttattggtggatttaatccttctcgttgccataataaagaaccttccacgatccaattaaggattcccacggattcacgttttaatttatcctttaagtttttatcaacttgaccatctggtatttttactttaaaaggaattagcatcaatcgtcgccaaattccgtcatcagtaccacgaatgattggtttatggttagtggctaaccacagcttaaactgtggtttgaattcaaattccttaccatataagtaccgtgcggttactttatcgccaccggttaattgtttaaccaatccctcgtccaatctcacaccctcattaggttcgcttgaggtaactaatcgggcactttccaaacgagcaatatctgagttggctcccgatttattttgccgtaccataattgaatcggcttgcattgacttggcataggttcccagaatatcagaaatcgtatcgatgaaaattgatttaccattgcgaccatttccatacagaataaacatcacttgttccttgatacttcccgtggcagagtatccaaccgctttttgaatgtaatggattaattcctgatcaccagcaaaaatttgatttaaaaattcatcccattctggacaatcgattttgtcggtgtattccacacttgtctgatgactgaacattttcttaatgtcgtggtcttttaagatacccgaagttaaatcaatatagccattaaccgtattcaataaagttttatcttgatcaaactgcccatgtaataccggaacccgatgttgtacttcgcttatcatggcttgtttagcagcatgactacgagacttcttcaaaaacttttcccaagctactttggccttttcaggatctacgccggcagcaacatgcaacttctcattcttcatattatccacagtcatatcaacaaattgagctgcttttccctgatcgtccatttcccaataactgccattatagaaataccaggacttatcaatataggaatatttgactagatttccaaaaacatcaataaatcgatcagcattcccagtatcatcccaacttctaggtggtaatttctttttgggcttagattgtaagaatttaagattatatttgtgcaagggatgttgttgtggattaaaggtttcccgagtttcattaatggatttgttaaggagtgaaaccccataagtggttttcccatgtttttcatcatatttcggtcgcataaggctagactttcgaaatatttcatccattttattaaaatcacggcccgtccaaaaggccaagtcattggaaaaggctagatcagcttctgaatgggaagtatagaagccctcccaaccaccgtgcataaacatcttgaaacgtttaccagtccgtgaaagttccgcgcgtttaataatttcatcaacacttaaatcatttggcctgattggtgcctgattgggaagctttaccacattgttttcaccgaaatagtgtttataaataagtttcatcacttgcggttgtggtgtatttatccgatcactgtatggaccaatggtttttccagttaacgcgaagaatcgtccggactcatacatttcaacgttgcctttgcgacgtcgatcaccaggaatcttgcccttaaaaatggcatgaattcctttaccggataaactaatttccacataggatttagtcatcgttaacacatcttgaacttcattttgttgataatcctgtgcagcgtatctttccagctcgtctccaatatgatcaatgtccaatccgacataaccattagcaaagtaaaacgcgagaccatccatttgatacgttttgagcgcttctaaggctgtttggtaatcagtccaggtacttgggtcattcgtgcgtccagctccaccatcgagcgcattgtggggtattttggtgtacttatttcgctcaggttgccagattttttgaaacaggccccattgttttaaggaccgtaattcatttggaattttttcatatgccactgtttaccctcctagaacggtaaatcatcgtctgaaatatcaattgaatctccagaattgtcaaatggattatctgttggggctgatgctggttgattaccagtgaatgggtttttaccgtccttttggtctttccatacatgctgtacttgtggataatcgctcttgctaaaattccaaggggcaatctgattgatgtctttcttttcaccgccataatcatcaaccgtttttttgacatacactttggctggcttgttagcaactgctttagtaaaatcattaattgtattcaatggtgttccttctggaatttgaacagcttcaagaatgtattggaaactatccaaatcgtactgattagtagttttacgcttccaattgtccataaagacatggcgattatgatacttggcattggtattttttaatccagtaaccccatctaagtcatttcgaacaactaaatccaattgcagtgattctgccccgttcttagttgccttctcctgggcagatttaataatcatctcgtaatttccacttggtaaagctgaaaaatctttgtgttcgttgttcttgtaatttgcttgcataaatgccatttttaaaattcctccattagttaaccatttttagtcgtttagcttgtacataggcccaaccagctttatacccacgggctttagcgatttctagtaactctttgtaactttgtgcatcttccggcttttttcttgccgtctggatttttgaataatcagtagtcagtttaaattccccaactttttcaatactggccgtttcatcaatttccattccgtcagcgtcatatttaatctcattaccacactgtgggcaaacacggcattgtgtcggtaccacggcaaaacaatttggacaagttttgactggaattgattttgtgttattctgccgttttttcttaggtcgtccttcaaggctccattgtcgtggagtatcaggcagaccaaaacgggtatagttagctgcatgatcaatgatagtggccattttatttggcaaatatcgcatacaacgcattgttgcttgaatatcaaataccaagctttcagttggccgtgcgattacacaacacgtacactctttgacgtcatatccttcatcaaccaatccaaagttacatagaacagtgatctttccctttctaaattcactcataatacgttttctttcgtcactaggagttttagaatcacaatgttttgcactgatacccgcttttctaaattcagccgcaatttgtttgctatgttgagtatcatgagcataaacaatggttcgctgtccaaatgctttatccatccaagttttaacaatatcgccatacagagtgggctttgctgaatcactaacagattgattggtgtaatcaccagtgcttgatttctttagcttttcgtcattaaacaatgtcacactgtagtatttatatgggcttagttttttgtgttcaattaaccacttaaccgtggggcctttgaccatagcagaataaatatcgtcaaaccctgctccgttcattcgccacggactgcctgagaatccaagcctaggaacatccgaatagtatttaaaaatttttaaatatgtttttgcccgactatgttgcgattcatcgcaaataattaagtttggtttaggcaagtgatctaatcgattagcaactttgcccactgtcatgattgtgcaattcatcaaatccacatcttgcttttgaaatgattttacgatctggttaactaattcttgacggtgaacgaagaacaaaattctaccaccctttgaaactgttaatctcgcaatttcagctataataactgatttcccactacctggtggggaaacaattagtaccccattattgccttggccaattttttggcgagtttcatccacaattcgttgttgataatcaaataatttaaatggcatttttttgacaccggatttctgcaaggtgacgttcttttactgcttcctcatagcttgtaaatgacctatccaatatgattcggtttcgatacatcattttagcgacccatttatttttgcttttatcaaaagaaacaccacgtacaccgctgatattgtctgcccgcaatctattagtcactggagagtttcgtttacgcctattgttggcctgggttttccaatcagtccaacggcaattagatgggcaataattaccatctacatcaattcgatcaatggattttccactttcatatccattttgaatagaccatctttcaaaagcataaaaactatttttccattgattacagatagatacacctcgaccaccataatcggaaaagcttttattattggggttgaaacatctttgcttcatagactcccaaacaaaataaagtttcgtatttgaatgaccgtgttttctaaaccttttactagcgagttcatcgtgtagacaaccacaagattgtattttcccctttcgaacatcgattcctgaagcataagtgacatttccgcagtcacatttaaatctccaataagcacgggtagatcctttaggacgttgagaattatcaatgcaaactgctgtcagtcttccgaatttcttacccgtaatatcaattagttttgtcatcgttgccactcccaaacttaaacagatccttagcagcacacatggttcgattgtccaaacgatttttggcataaatcgagtcatttccttgcagcataacgccacgaccgttagtcttcggattaataatcaaccgaccaaccacatcacataatcccagcattccatccatcacgctttgacgaatttcgggtgcatattgattaaattgctgaccattttcagtagtaatttggcgttgtgtctcccaagctgtggttagcacattaactggcaacgcatagatagcagtcattactctcgaaaaataattagtccattgtgaataatcctgcaattcatttgagatgccgttatgactacccttacccttttccacaaaccaatctttttcaaagcttgatacattatcaataactaaattgtcgtaaccaacaatcaattctgatgcctgttcaagatactgcttcatgtcttcttcagggtgagttcgatccatttcatcgactgtaacgttgctaatgccagctaatactttagcggagttatccaaatcaaaaattctagttttaccaggtaaatatttaacacaagttgttttaccagttccgggcttagcatatagaatgactcgccaattcaaggttcgctgcaaatctttagctttaatcgtcttcatgattaagcacccactctttgataacgaatttggttactatccatgaaagccctcaacagtttcatttgtggaattgttgccgttatttttaaagacactgaatgggaaacaacttcgccagtattggtatcaatcgttttacctttctgctgaacttgatgtgtttgtgcttccgctgcttgtgcttccagagtctgctgtttttgtttatttagtttgacctgattatcaattgcttgaagcaaataattaacatcttggccttgctttaattgatcaatccaaccagccggatcgatctggtaagcttgagcatatttggtaatagtactgataccggtttttaaatcatcgtgttgctttttaatgtaacccatcacatcagcaattccttcggttactttcttcttggtggtggttttatttaaccaagtaggatcaatttcaacctcgcctggttccacatggtaattaggtgccatttcagcaatcaaagattgaacatgttttaagcgaagctggcgttgctgatcttccaattcctttagcccagcatcgattggattaattgatgaatctaaagtggcttctaagtctttaatttgagctgcaaaccgctgatatggttcagcgtatttttttctgatttctttacgcttatcatcaagggcttgcctcaattttcgaagttctgctcgactggacttggcttctttttctgtggaagctgttactgccattccttgatatttattggcatatgcttctacagctgtttttaattgatcaaaattattaattgtaatcacaggtagctgatagtcaatcgtgtattctggtagggataattcatttgccatttatatttacctccatcttttaatgtaaatagtgtcgttgattaattgaatccttcattgacgctatttcttttcttttagattttgtgattctgccacagattaatctaattggttcgggataaattgggactcgttctttccgcttcttcataaaatccttgtcggtcccagttacgacgtaagtcggatactttatgctgagctttcgcataacgtcggcacgagagacaccagtttctaatatttgggaatccattacaccaactgctttccaaaatttagtcattattccacctcgtgatgtaaaatatattcagatagtcgttgcttttctttatctaggacaaagaaatatgccaacaagctatgatcgttttccacgggtgtgcgtccaataatcatattcaaacgtttgatacggttctgtattgttaatgttttcattctgatgaccctccaggtgttataatattagtagttatagtccacccatttgcggtagtgggctatttagtgcatataattaaggtggtgaatttttatgaatttttacaattggttaatgcgctttaaagacgttagcttaccagttggtgatgtagcaagagaaataagatctgatagatcgtttcctaagggaaatttagattggaaacatttaaaagaatatcttaagtcaattggtttctcagattccaaattagaaattgttaaaaacgtcttcaactattatttagcggagaaaagtcgctaattaataaaatccagtaatcatttggaagcttcatattttcttggccatatttgcctcgtatttcagtattggcataaaggccaccatggaacagttgggcttcctttctttttcttaattcacctattaattcagatgtcgaatacttttgcaatttattcatcgatatgattcctttctattttttagtgacgcccagttggtgtaaagtattcaatgaccagggctgctaagaacaataaaactagtacttccaatgattccattaatcaaatcactcctttttaatatttgtagaattttgaattcaacccattaaggaggctaagtcgtatgattcatcaaatcgtcacgatcgattattagattttccaagaatttaatgtttttaccaattgaattcactccaatgatcctccaggaactgctgcattttggtagctttaaacaaccagggactacctttactgccacgatggactaaatatctatcatccattaaggcttgcatttcccgtgaatattttggattttccaagaaattttcctttagccattgtggtgatttgttcccacaccatttacgaagatcgtttaaattccaagtccgtccaaatgttgattcccgttttaacttttggtaatcttccttatttatcaattcaaaattatcaggaatttgaattgaaactttagcactaatgacttgagacattttgtcacttcctttagttgtatacttgatttatcccaattaatcgaggtgataaatatggaaaagtctttcgatgattttatttctagcttatctgatgaagatatctgtaatatagtcgatattaatcaagaacttgctaatgttagaaatacttcagccgttgaaaatttgtttggaaatcaaatcgcgtttcctcttatttgattagtctcaatttactgcgttactatcatgaatggctgaacgcatagtacttataatatctttagaattaatttcagctttactgttgacccctgtgttacttgcgataacatggaggtctttttctattgcccataaaacgtggattaattgcttcatgttgtttcctccttatgctgtctgctcaatgcagtacatgttgttctgataaatcttcaatactcgaaatagcattttttaaaattctaatagctcttttctccgttatgccattcccccttagatcatcaatgacctttttcaacaattttttgtctttttcacctttttgtttagcgtcatcgaatacaacatcgtatgcttttttaatttcctcatagctataattcacttttttatcttctgccataatatttgtatgtcctattcatctttatgctgtctgctcaactttaggcatgatcccctttgattcgagaaagaatttttgataaaagattaaatgctcttttacgcgattcttttgtcattggcacgattttttccttattgcactccttgctaccacaaatggctcggggtgttttttctgcgtcttggttcactttattcacctcctttcaactattcattgacgatcacttggcttctttctaggacatatgaccaagtaagtaaccaattgtcataaatagaactcctatcgccatatttaaaataggctgaatattactatcaaagtactgatgcagtttgcctttttccattcaactcatctcctttctatgctggctgtgccttcgctaaacttgcataaatcgccttacttacagacaaccccaggttatagcgatcattaaattccatcagcttcacggtgtcgtctaaaacagtttcccgatcaactaacattgctggagtcatctcgcctttctttatcatctttggatagccatattttgttgaaactgctttattggccacagtgttagctttgataaagttaactcttactggccgtttcaagccgtctctcaatcgtttcatggcatccttctggtgttgtttgtccatcatgcgaaatacttcgaaaccctctaaaccggttgcttcacgtaattgcttaatgacgttgaagacccatcgtttaaatgatttggcctctggcttacggctcgaaaagattgcatcgtaaataccaaattcgctaactacagaagtcaactgctttcgattcaaggaatctaagatggggtactttgaaagtacgtcatcatcaagacgttgattcagttttcgagtatccagagacaatgcttgcgcaatatctgatagtactgcccaccactcaccttctacttcgacaaatcgaatctgatgatcattccaattttcgattttcatttaaatcatctcctatgctggctgtgtggacgtatctggactaaataaaaacttgagttcatattcaggaaaaaagctttcttgaatttttaacgcttcactgaatttgaatgatgacgttccattaattttgtcagcgatagtttggtaacgaacattcaaaagatctgccatatcaactaaagttacatttttcttctttcgaatttcttctaaattatttaacataatatgactccttcctaatacgaattttcgtatattagtttaaaaaataatggctcttcatgagcacatttttataatatacgaattttcgtatttagtcaataccaaaattcgtatttctttaaattcgttcatttacatacgatttttcgcatgatataataaaacatgttaaaggaggaagtaagcatgaacaaggaagattatttaaaagatttaatagaaataaaatttggtaacgttaaagcttttgccgattctataggcatggcttatacaactatccgatctattctggatcgcggcattatgaatgctaaaatggaaaatataataaaaatatgtgatggattgggaatcaaaccagaagacattgtcaagttagaaagttcagtcgttagtgataccaataaaataatgcttcaactccacccttctcgccaagaaaaagtttacaattatgccagtgaccaattaaacgaacagaataacgaaaaaataacttcaatgtttgaccacaagccgatgattgaaattcctgctgggcgttcaactgctgccgggtctcctattaatggtgaggatcaagatacccaattaatccacaagctgattgctggtgagaaggtccccgcgggtgctgatgaattagttactgtggatggtgattcaatggaaccattgctacaaaagggtagtcaggtattcattcactatcaaccagaggttgagaatggtgaaattgcgatcgtccacattcgtgatgttggtgttacttgtaaaaagttttatgtaaatgaggataataccgttaccttaaaatcaattaacaaggcatacgatgacatggtgtttgattgtgatgaagttaatgtaatcggtaaagtgattttatgagctcccaaacgtgggggcttcatttaaagttttaaaagaacatatgtttcgactaaccaggtggtttgcttaggttcgagtcctaaatagtcaatatttgaccgaaaaaaatagccaacgttctctggataaacgttggccacaggaaagaatcgatcgtgaagcagctaatatgtattacaaatttttggtaaatatccacgataagatcagcagtaattttaagggacttgctaaacatgatccaaataaatggcgacactttatttcagttaatgagatattggatcaactagaagaatctgttgttgagctagattttgaatagaaaggctaatacacaagctttgcagcaaacaataattatacacagtaaactttttcaggttgatacgtaaggcatcaaccttttttgcatacgaatactcctacggttatcggaattttgaccattatcgaactaggattcaaatggaattatttgcttaattcaattaatgcaaaagaaaaagcaaaccctttcggatttgctatataagctgatatcaacctcagttgacaaagagctcgaaaatattgacacttctttattttacacaagcttatattaattatctaaagcaaaaattaattaaacggtgtaacagtaccagttgaagtggaatcagatggtttagtaacagatgatgcatcaggataagtatatactaccttaacactaccatttgtattaaatgaaccattgtcagcactattagcagtataagtaaactgcttatatcctgtaataactaatttcttagatgtgttacggccaaatacagggaaaacagggctcttaagggtatccaaaccctttgtcttcaaataacttaaaacatcactcgaagtgaacgtttgacctgaagcaccattaaacaaatcagaaggctttaaattggatggtgcaatatactgagcagaagctgctgacgatacagctttattcaacttaaccaaagttggagaatcaatttgagttgtatttacttgaagttgacttgcaacacctgtaactgtaaattgtttaccattccatgcattagtgatatcatcatttccaactgtagcaagtttatttgaatgtactgctactaaatgattggcttgagtaggattaacagtagaatcacttgatgaacgactatatggtgttacttgaacaaatacttggttcccctttgaaagcaccaaagtaaccgaagaaccagtggttgcttgagctaattgagcaacttgactagcagttaattgaccattagccaatgaataggaagtgccactaagggcactatttatatcacttgtaattgtcttttgtaaataagaatccaatgaccaagtataatttccattattattgacatcactcaatgtacctaaagtatcaccctttttagcattaggcttagttacatcaagagatttaataacagtaccatcagttccaactaaattcaggcgaactgcgttatctgcaattgggttagcaacagtgacatcagatgcctttacccaagcgccattaaggtcggagtttgatgaactaatttgataccagaggtcaccctcacgtgaagtagtaacagccttgcttacagtaaatgttgcatttttataagcgtcagtagaagtaattaccttaccacttgcatccttagcacggccaactttatattgagtccatgctggagctttgaataaagtagtattagcagttgtgctagttgagcttaacttataagtgttagttgatgcaggagcagtagcatccttagtagtagcgtatgaagctacaccaccagcaaatgctgaggcactcttaccaccataaatccagccacgatattgtttatcgaatgatacaaccttgtagtaaactgagccacggttagtagtagcaacacggtaagcacgtaaattagccttgccagtttgtgcattagctaatgctttggtagtagtcttagttgcaacggtcttggcacccttcaaagtaccagcctttgtataaagagcgttagtaccattaaatgtaacgttacgagtagtagcgtcagaagttaatgccttatttgatgtaactttggcatatgattttgcactagcatttgtgctagatacaccggcaacagctacaaatgataatgcagctacgccagcaaaaagagtctttttcaatgactttttcatgtgtaatttcctcccaaaaaattgttttttcaagttacctagacatgcaaaaacatgcttcaattaacttgctgtaaatagtataacataatcaaggttgaatgcaaaagaaaacaggagttgtaaaggctttaacatttttttgtaatctatatgccatgataattaataaatgatcgctctattaagtagattccccactatgtgttagtatattacccaaaggagaataataatgccatcaatacgtaagcatggtcatggataccaagtaagatactactattatgatgccaatggtcaggaacacgagaaaactaagagcggctttagaactaaatcagctgcaaagctatttgcgagtcaattggaaatcgatatccacaatggtttggatctcgttcctaaagatcctaagtttgctgactattttgactatttttatcacacgtacaaagaacccaaaattgagaatcagactaagaatcgctataaaataactagtcgagtattacataattatttcggtgatgttactttaaaaagtattgaccgaccacaatatcaagcatttattaacttctatggtcattctcatgcaaaagatactgtttataaagttaattcactgattagagcaaccgttcaaaatgccattcttgacgatctgattcataaagatttcacccagcgagtcagtcttatttatgacaagtcacgtgataagcatgtggaatacctcaacgtggctgagattaagcgtctcatcgcttatttggagaatcacttaaactatcactttacctccacttttatgatcctgacggccgttttaactggtgctcgcttgggggaaattcaagcattaacttggaatgacgttaattttaattttaaaacgattagcattactaaatcttggaattcatccgaaggcggtggattcaaagataccaagacggctggttcaaatcgaatcattgcagttaatgacgaattgctgaaatcattaaagatcttgaaggatcacaataatggagaactaatttttgttaatcaatataaatccattccatcatcctctgccgttaataaaaagttgcgttctatactaaaagacttaggaattaaaaagcaaggctttcactttcattctttacgacactcacatgtagcttacctactatctcgaggaattgacatttacatcatttctaagcgtttaggccatgctgacgtatccacaacaacaaagatttattcctatttaatggatgaatataaagcaaaaaacgatcaacagattcgtgaagagttagataacctttcctctcatgatgaaactataccaatcaagcggaacctttaataaggttccgtttttatttggttattttactctgtatcaggttaaactttttctgcccgtttggccgttatttgcccgttattatttatattttaatactttctagtacgcttttataaattaaaaaaattaagaatgcctatttaacagcattcctaattttaatatttcttctaatttgtataattatgccgactgcaggagtcgaacctgtgaccctcggtttacgataccgatgctctaccaactgagctaagtcggcaaatccattgtacaaaaaatgctaacaattaagttagcatttcgacaaagtctgatccatctaccaatgttatataacaatattttaggaactacacatgcatggattggtattttaatcgttactatttggcaaggattagcatttaacacactaatctatttggcagggcttcagtcagtggatcctcaaatatatgaagctgctgctttagatggtgttggtccttggcagaaatttagaaatattacttttccattaattgcaccattttttacaattaacttggttttatccgtaaaaggatatctgatggtatttgatcagattatggctatgactaatggtggaccggggaatagtacaacatcaatttcagttgagatttacacacaaggatttcagggatcacagtttgcaatccagtctgctaacgctgttgtgttgtttatagttgttctagttatctcactgattcagttgagtattttaaataaacgagaggagaaattaagctaatgcaagcaaatattgaagcgcagaataatgagcctcagccacgaatgaaaaaacacaacaaaaataagcatattaattggacgcttacaagtgttttgatggttattgcaatttttgcaattcttggcccaatctatataactatagttattgctttaaaagatccttctcagatgactaatgtcctttcgttgccaaaaaaaatccatttggaaaatttcgtaaatgcttggtctatgactaattttccaaaaatgttttttaatactctgtttataaccgtagttaatattatttttacgatttttactaattcgatggcagcatatgttattaccagatatagaatgaaaaataagttttttaacatgatgtattactattttattagtgcaatgtttattccatttaacgttattatgcttcctttagtgaaggaaattagtgccttccacatggacaacattattggaattacatttctttatattgtttttggattacctcagaatattttcctgtattctggatttgttaaaggaattccaacggcattggaagaagcagccattatggatggtgcaaaaccgtaccaagtattcttcaaagttatttttccattaatgaagccaatgcatgcaactgtggcgatactctcatttatgtggacttggaatgacttcttaatgccacttgttctattaagcgatccgaatcagcaaaccttgcaattggcgcaatatgttttccaaggccaattttcaacacaatataatttagcttttgcttcgtatgtactggtcttgttacccgttctgctgatgtacgtctttttccagaaatacattattgcaggtgtaacaagtggatctgtcaagtaattcaaggggttttaaggagaaaagtatgaaagagcgaagaagtgagaattggtggcaatcagtagtagtttaccaaatatatccaagaagtttccaagattctaatggagacggaattggcgatattaagggaattattaagcgattggattatttaaaaaagcttggtattgaagcaatttggttaagcccagtgtataagtcacccaatgcagataatggatatgatatatctgattacgaagatatcatgaccgaatttggaacgatgcaggatatggataagctcattaaagcagccaaaaaacttaatattaagatcattatggatttggtggttaatcatacatccgatgagcatagatggtttgttgaagcaagaaaatctaaaacgaacccatacagagactattatatttggcgagacccagtcaatagtcaggttcctaattcgctaaaagcttcatttggtgggagtgcatggaaatatgatgaaaagagtgggcaatattatttccatctttttagtgaaaagcaaccggatttaaattgggaaaatagtgaattacgcaattctatatgggaaatgatgaattattggattgacaaaggcattggcggatttagaatggatgtcattgatctgattgggaagcaaccagataaattagttacggtcaatgggccacatctccatgattatcttcaggaaatgaatgccaatacttttggagataaagatatgttgactgttggagaaacatggggtgcaacacctcagaatgcttctaagtactctgatcccaaaaggcatgaactctcaatggtttttcagttcgaacacagtatgctagatcaagaaacaaatggtgaaaagtgggatttaaaacgtcttgatgttcaaaaactgaaagatgttctatataaatggcagacttctttaaagaatggatggaatagcttattttggaacaaccatgacttgccaaggattgtatcacgatggggaaacgattctgacgagtatcgtgtaaaaagtgcaaaaatgtttgctatcatattgcatatgatgaagggcactccttatgtttaccaaggtgaagaaattgggatgactaattatcctgtgaaagatatatcagaagtagatgatattgaaagtattaatatgtacaaagaacgcattgcacgggggtacaaaaaagaagatgttatccattctattaatgtaaaaggacgagataatgcgagaacgcctatgcaatgggatgacaaacatgaggctggttttacaactggagatccatggctacatgtaaataataactacaaaaaaattaatgtcttgagtgcgttacaagacaaaaattcgattttttacacatatcaaacacttattaatttaagaaaaaagtctaagacagtcgtttggggtgattttgttgaaataaaagatgttcccaaaaatgtttttgcttacgaaagaaaagatgatgaacataggtatttggtaattgcaaattttgatagagagaaaaacagcatacaattgcctcaatatggaattcaagaaaattttattgtaagtaattataatgaaatgtcagtggatttaactaactatacattaaagccttacgagtcttttgtagttcaaattaattaaaatactgaaatttaaagttgaattgattaattatcaaactaaaacttaaggggatgtcacaatggttgaaattaatttaaaacatatatataaagaatatgatggaaatacatcatactcagtaagcgattttaatctagatattaaagataaagaatttattgtttttgttggcccatcaggttgtggaaaatcaacaactttaagaatgattgccggtttggaagatattactgatggtgatctagtaatggatgggaaagtaatgaacgatgtgcagcccaaagaccgagatattgcaatggtattccaaaattatgctttgtaccctaacatgactgtgttcgataatatgggatttggcttaaagattcaaaaaatgcctaaagcagaaattgagaaaaaagttaataatgctgctgaaatattggggatgacagaatttttgcaaagaaagccagcggcactttcaggcggtcagcgccaacgagtcgcattggggcgtgctattgtgagagatgcaaagcttttcctgttagacgaaccactatcaaacttggatgcaaaacttcgtgttcaaatgcgtacgcagattgctcagttgcatcaacgattgcaaacaaacatgatttatgtgacgcatgatcaagttgaagccatgactatggctgacagaattgtaattatgaatgaagggaaaattcagcaagttgggactccatcgcaattgtttaacgaacctgttaataagtttgttgctgggttcatgggatcaccagcaatgaatttctttgatgccacattgcgagatggacatgtagttaatgacaaaggtttaaacgtagttgtacctgaaggacagctaaaaaaattagtagatcaagggtataacaacaaaaaattggtagttggaattagacctgaagatattcatactgaagaagttgctcttcaaacaatgcccgatgccgtagtagatgctacagttgtagtttctgagttactaggagttgattcaatgctctattcaaaaactggcgatacagagtttgtagcacaagtcaatgctagagattatcacgaaccaggtgaaaaagtgaaaatggcatttgaaatgagtaaagctcatttctttgatccagaaaccgaaaaaactatcgagtgattaataaaaagggattgggcgtaagtcttgcctgattccttttttatagaggaggagattaaatcatgctacgaacttttgaaatcgatccgtggaaaattgtgactcataagctagacaaagaaaacaaacgacttcaggagtccatgaccagcattggtaatggctatatgggcatgcgtgggatgtttgaagaagactattctgcagatacctattctggaatatatattgggggcgtctggttcccagataaaactgttgttggctggtggaaaaatggctaccccaagtactttggcaaagtgattaatgcagttaatttcgataaggtcaatgtttggttaaacgaagaaaaaatggatttagctaaaacgccaattaaagattttgaattatcattaaatatgaaaaacggcatcttaacccgtaaatttacagtggtcgaaaaaggtgctgaggtacggtttactattcgacgctttgtaagcgttgccgaaaaagaattgtttgatgtagattatcaaattgagaatttaggcgatcaatcggtttcggtaaaaatagtttccgaaattaatgcggatgtttttaatgaagattctaattacgatgaaaaattttggaatgtgaaggccaaagatcaaactccggatagtggttatttgattgcagaaaccaaacccaataattatggtacgccacaatttacggttggtatggagatgacacacaagtctgaacttaaggcgattgaagaagctgttgatgatcaaaaggtggccaatacgttcagtggatcacttgatgctcagcaaacgacgaatttcgaaaaacgtgtgatcgtggttacctcccgcgactatgacgatgatgcgactcttaaagctgcaatgcagaacttaagtcaaaaactgggcgcaagtaatcatcaaaaactggtcgatgatcaaacgaacggttgggcacaacgttgggaaaaagctgatgttcaagtttctggtgacgatgcggcccaacaaggcatccgatttaatctttttcaactgttttcaactttctatggggaagacaaacggttaaatattggaccaaaagggttcactggtgagaaatatgggggtgctacctattgggatacagaaggctttgcgattccactgtatctatcgttagcggataaaaaggtttcagaaaatctattggagtatcgtcacaaccaattggcaggcgcgtttcataatgctcgtgaacaggggctcaaaggtgctttgtatccaatggtgaccttcaatggtattgaaaatcacaacgaatgggaaattacatttgaagaaattcatcgaaacggcacgattgcttatgcaatttacaattatacccgctataccggtgatgagacctatctgaagacaaaggggattgatgtattaactgccatctctcgtttttgggcagatcgcgtgcactggtctaaacgtaagggcgtctacatgatccacggggtcaccggcccaaacgaatacgaaaataacgtaaataataactggtacaccaatatgttggcgcaatggacattaaaatatacactcgaaagtttaaaaaaggtaagttcagagaagttaaacgagctagatgtgagcgcagaagagaaacatcactggcaagaaattattgataagatgtatttaccagaagataagcaacttggtattttcgttcaaaacgactgcttcttagataaggacttgaaacctgtaacttcaattccaaaggatcagttgccaattaatcaacattggtcatgggataaaattttacgatctccgtacattaaacaagccgatgttttgcagggaatttggtacttcattgaccgattcccagaagatgtcaaaaaacgtaattttgatttttacgagccactgacggttcatgaatccagtctctctgcttcagtgcatgctattttagcggcagatttacactatgaagataaggccgttgaaatgtatgagcggactgcacgactagatttggataactataataacgatacagtcgatgggctacatattacgtcgatgaccggaagttggttagcaattgtccagggatttgcaggaatgcgagtcacgaataataaattatcgttcaaaccgtttgtaccaaagaaatggacttcgtatcaattccgcattaatttccgcggacgtttaattaaggttcaggttgataaagatgggacgcaaattagtttattaaaaggcgatccactaactgttgaactaaatcaacaacccttaaaacttaaaggaggcgactaacgtgcaaggtgttttatttgatcttgatggtgtcattactgatactgcaaagtttcattttaaagcttggagtaggttggctcaagaaaagttagccgtcacgttacctgctagttttgaaagtgatttgaaagggattagtcggattgattctatgaatcgaattttaaagttcgcggggcttgaaacaaaatattctgctgaagaagtcaacacgatggctcagttcaaaaatgagttgtacttaaatgaaatcagtaaattgacacaaaaggatattttgcctggaattgagaatttgctggatcagttggctgcaaataagattaaactctctgtggcttcagcaagtaagaatgcaccgtttatcttggaaaaactgggattaaaggatcagtttgatgcgattgcggatcctgccaaagtggcacatgggaaaccggcgcctgatatcttccttgaagctgctagaaagattgccgttgaaccaagtcaatgtgtaggtattgaagacgcaaaagccggcgttgaggctattaaagctgcaggagccattgccgtgggtgttggtagttctactgatttaaacgaagccgataccgtggttgccaatactggtgagttgacctattcaattttagaacaagcctttggtaaaaaataatttggtattaaaaaatccgttaacttttaacggatttttttttggttaattaaatgtataggaattttgataaattaacggatttccgggtgtgatgataatgtttccaaagcctgaatgattaggggcatctggcaacatttgcggttcaatggcaagacccagttgagaagtcatatgacgtgtgccatcaaccaagaaatctccttcaaaccctgtagtggaaaataatacaaacgaattagagttggtgtggatcgctagttttcttccggacgatggatcctgcaagattagttgtgggtctgtggatgtttgtgtgttaattttgaagggcgtatctagcccgttaggtagttttgccagagcgtcacctaaatttgtgggttggcgaaaatcaaatggcgttttagctaccgataataagttacctgttggcatattggaagcatctgtttcagcgatcgtatctgcgttgatctgcaactcatgatcattaatgattttttgcacatttccagataagttgaagtaaatgtgagtagttgggttaaacaaagttggttcggacgtattgccaaagtaagtgaccgtaaatttattattttggtcaaggacaaacattgccgaaattgaaagccgtcccggataaccgttttcccctgcaatactaatgtattgtagaacgacgccaatttgattgttcgttttaattagcttaattaagttccaatgtgaatagcttatggacggatgatcgccaccatgaatatggttcggaccactgttttgatcaagagcgtgaccgttccattgtgcaccgcttaagcgtcccgcgacccgagccacagtggcaccgaaaaagtcatgatgctgggcataatcatgggaatgcataaaacccaacgtgatattggcgacgttgccatctttatcgggggtattaattgccacgacagttgcaccaaaatcactaataatgaccgaaacattctggtcgttggttaaagtgaaccatgttgattgattgtgaatttgtttagaaatatccatattgaatcctccattcgagtacttaagttaagcataccgcaaacgttttcaataagaaagaatggcgacaattatatttgaagttaaggaaactaactttaagttgcgtttacgaaaggtaacgcctaaactaatagcatattggaaacacagcgggggtaatctaatgaaaatagactggcaacaacttttctttaacatactaaaatttattggaatgttctttgtatatcaaattggaacaattcccttacagatggcctatttaatgccaaccaaccaggcctttgtcttggttgcgtttgtcatgtacctgattacaactggatttatgttagtcttgtttattcaaatgtataggacgcagttgcgcaagcacaatttggctcattttgggcgaacaaaaccgacgaaacgaattgttatttttatgatcatgattgtgattctttggatcttatttttagcaatgcagatttggatgaatcaggcgaaattattgccaacttcacaaaatcaacagacggttattgcatttgcaaaagccattccttggtggatgggcttggacgccgttgtctttgctccgattattgaagaaattttatttcggggattcttttttaattggttttttaattcaaatgacaaaagaatgcagcttattggcgtatttttaagtggagccatttttggagccgtccatgatgtgagttctttgttgggttggctagtctatgctctcatggggtggttgctggcactcacttatgcgtatacaaaagatattcgctacaatattggactgcatgttttcaataatctgatttcgctaatttagcgattaaactagatatgataatcgggataattgaaactgattccgtgacaaggcataatgaagatataagatattttagatttttggatgggagttttgtttatggaaaaacattggtggcaagaagcagttgtctatcaggtttatccgcggagttttcaagacacgaataatgatggtatcggggatttaaatggtgtcattgaacatttagattacattaaaaaacttggtgcagatgtcatttggttaaatccaatttataaatcacctaacgatgataatggttatgacattgcggactataaaaaaattatgtcagagtttggtaacatggcggactttgatcgtctgttagaacaagctcacaagaaaaaattgaagataatgatggatttagttgttaatcatacttcggatgagcatcattggtttgcggaaagtcgtaaagatcgcttgaatgattatcgcgattattatatttggcgtgatcccaaaaatgatcaggaaccaaataactggcaaagtgcatttggtggttcagcttggcagtttgatgaaaaaacaggtcaatattatttacatctgttttcaaaaaaacaaccagatcttaactgggataatgttaatgtacggcattctgtgtttgatattatgcgcttttggttagataaaggcgtggatggattccgaatggatgtcattaatttgatttctaaacctgagggtctacctgatgttaaagttgatggtcaagccaatttggctgccaatggaccgcacgttcacgattatttgaaagaaatgaatcaagaggttttgtcatactacgacgtgatgactgtgggtgaaacgccaaatgcctctacacgagatgcaattcgatatacagggttcgatagccatgagctagaaatggtttttcagtttgaacatatgggccttgatggcaatgagaatccgttgatcggcaaatggagtactaatcgggtaaagttgaccgacctaaagcaagtgatgtctaagtggcaaacagatctaaatggtaaggcatggaatgctttgtactggaataatcatgatcagccacgagcagtttcacgttttggcaatgatcaagagaaatttcgcgttgtctcggctaagatgcttggagcaaccttgcattttatgcagggcacaccctatatttatcaaggcgaagagttaggaatgaccaatgctaatttcaaattgttagaacagtataaggatattgagagtttaaatgcctatcacgaactggtcgatcaaaaaaagttggtgacttcccaccagatgttacaatatttgaaacactcgtcacgagataatgcacgtacaccaatgcaatggaatacttcgaagaatgctgggttcagtaaagcaaccccatggcttgcggttaatcctaattatgatgaaattaatgccaaacaagcagttgacgatgagaattcagtttttaatttctatcggcgaatgaatcaactgcgtaaacagtatgatgtaattgtttatggggattatcagttgttagatccagatgatgaccaagtttgggcatatacccgtcatttagacacacaagatctattagttattagtaatttcacagaaagaaccgtacagcggtggtatgatttgagccagcaaagtaataaattgaagcttttggggaattatgctgacgatcaaaacgagaccttacgcccttatgagtgcaaagtgtacttgattcagtaagtgattaaaacttgtaacatgcatttatgatgaatagttgtataatggattttatgaacaaaaatcgctgaataatcagtgtgggaggtttagtatgctttaccaatatccaacattagccaaaatcaatgaaacaggaaacgcaattcgggttaacgaaaatagtgtcattcaaagtttgccaaatatgtcaggggtcgattattttgtcaaaagtaaggatcaacatgactattatgtttttattgatcgcggtgagcagggtggagcagttattcataccgataattacagcgatttaggctttttcttaatcgaaacaccattgtctgattttgatctagacattaatccagaaacaagtttagtggaaatgtacgatggagctggtgttgtcacggattttacggatgcggttgaaaaagatgaaatcaaaaaaatgcttgatgaataccaaaatgcttcggatgaagaattagaagcaagtgatgtctataaagagctagataaatatgtgagtcgttatctggaacttgacgaaacgacggaaaaacatgtcaatttggctataattcgaattgcaatcttgagtattagtcaacaaagtgcaacggagcagtaaagtaaagagagtagaaaaaaggacggttagattctgagcatagcctagactaacgaatgatccatactttggatcgttcattaggcgtagctaagcgaaaaaatctaactgccttttttacattttagaaataatattcggcctcttcttatttattaccaccaaataaaaattaataaattttcaattaaaatctgttttaaggtttttcgtattttatggccgtcaggggtgaaattgttaagaacatagctagccttatggtcgttattcttgaaataaaaaacaattttttctgagggcgtatcggtggtttgccagtaaaacggtaatgcaccaatagaaggcagtacgtctaaaaaagtaaatttatgtggaaatctttttttaagaaactttgaattgcatgggcgttatagttggttgcccgctggaagccaaatttgccttcttgaatgtgggaaatgtgttcccactgattttgaacatctacagggagggcagcaagcgtatcggtccatgatccggttttcggatcttgtttaaggataagattctcgtggggatttaattcataggcatagccgatttgtaaaagacggctatttttctgaacctgccggaataagtttcgaattccgacttcccgaatgattttttctatgacttcataaatggtggctagttcccagactgttaaacaccaatatacaattgaaccaggggtgaaagaaaaaggaattaaaagcatggggataatctgatacagccaaacgtggaacaacggcataatcgacatatggatacttaacgcaaagagaccgaacgataaaacgccggcaaaataggttattaaaccaagctaagtgattattcgaggaatcaatgcgtagtttacaaatagggcatgtttgaaaatcttaaaatttttaaagttagtttgaaagctttgcagcagttctggtactgtattgggattcttcatgcaggtgttcctccgtaaaatggataggttaaggttgataacattttctagtacatcactaaacatattttgtacacaagtttaccatacatatgttaaaaccaatagtttgattaaaaaagtgattaagacgaaattatgagcttttgaagctaagccatttcatacttaatcactttttagtttattgaagacccgtattaattggattgggaaggatcgtcctgtggtttactttcaaaatcagggatgagatgctcatcgtctaaatggagaagaagattgtaaagtgcaccatacaaacttgcatcgttcttaaaataggccgaatagatttctggaacagacaaagttttgcgcagtaacgtattgtcatctctaagtaattgtaattgatgttttatttccggcacgaggatactttctgcactgataccaccgccaatgacatatctgcttaaatcaaggacagcttgagtattgataatcatataggcaattctgcggcagtactggtcgaaaatttttcgtgcggcgggttcgccattttcaattgccttgaaaacacgcatcccatcgttatgatcagtaaagtccaatacagttgcaatattattaatcattcttactgctgaacctgcattaaacattaaattatcagcatcatctgctgcaccgttaatttgcgagagcataaaacttaggtcaccaccctgagcattagatccataccaaaggtgaccatttagaatgatgccaccgtccacagtggttcccaagataattgcggcaccatttttgatttcttttaaattacctagccagagttctgctagggcggctgctttaccactgttttccatggtcaccggcaagtcataccggcgattaataattttacttaaactaaggccgtgtaacattgggagggcgccgccgtgataaataatttgttctttttgatcaatacggccaggtacactaaaagcgacccccctgatatgtggaaggacttcgttaattacgccatataatttttttaaaaaactatccacactatcgcgcggtgtactaaactgggacttaacttttaaattaccactatgatcaattagcgcatatttcgtatatgttgcgccaatatcgatagttaggtaatcttttcccggattgtaattcattacgtttttcccttccttaactcaataaagctattatagcgcaattgacagcgatatcacaattcgagttttgagagtgtgattttctaatagatgaacccaataatttgttacagaagtgaccaatttttttataatgtaaattttgtcaggaaaaatacttcctaattccatggatttgatttgctattctgacgtaagtctttatactaaaaggtatccaaacaacgaggagaaatgtatgaaaacagcaattgtaacggatagttctgcctacctttctgaccaacaagttcgtgaaaatgacatcattgtggtaccaatcacggttatttttgggcaagaaacttttttggagaatattgatattgacgatcagttgttccatgaaaagctccagacttccggtttgatgccctccacaactcaaatcacgttaggacaaatgcaagaagttttcgataaattgattgccgaaaattacgatgaggtgatttgtatccatctatctagtggcattacaagtttcatcgaaaacctaacggaatatgcaaaaggtattacagaaattaatgtcctcccgtttgattcgcgtatgactagtcaaggtgaagctaacatggtcttgttggctgccaaattacgtcgagaggggaaaactggtacggaaattattccttatttgaaacaccttcgtgagacaactaaggttgattttatggtggataatttaagctttttgatgcgttcaggacggatcaccaaccgctcggccattatgggaaacttgttaagaattaagccaattttagatatggatgaaaagggacgtattgtgattcaaagtaaggaacgcacacggaaacgtgcacttcaaaaagttttggataatctacattctgatttggaccgtggtgaagatgagtatcgtgtttccattatttacggagtagaccatgatttaagtgccaaatgggaagagaccattcaacaagagtttccagcagctaagtttgagagtaatcaattggggcccgtaattatgtcccacaccggtgaagaaatcgttggtgtcatctggggtaaagattgggaaaaaattaagattgacgaataaagtagaactttggctcctatttctacacattttaaaatagtttattgaagttaaggcggactttcaagtcaactaattagttgaattggaaggctacttttttgatttaaacttgagaaacttctagaaaaatggtatattattaaaattaaattaaaaaatgagaaagaagtgttagttacatgaaaccagttattgcaattactgcagatgtgagggtggctgattcagaagttattaacgaacgccgggctgactttgctcctcgtggtgcagtagacgcagttttagcagcgagtggcctcccgatcgttttaccttatactgctcctgagttatcggaagaacttgtgaacacgtttgatggtttgttaattccgggtggtccagatgtggatcctaccttctttggtgaagagccgattcctgaaattggtcgaacttattataagcgtgatgcatttgaaattgcacttgtcaaagcaacaatggctgccaaaaagccgatttttggaatctgtcgaggaattcaagtgattaatattgccatgggcggcacagttttccaagatttaggtgtgcaagatccaagttgtcgaatccgacatgcgcaggcggctcccggtgaatttccaacgcaccatgtggtcattgaacctcatagttatgtgcgatcaattctcaaaacagatcgcagttatgtaaattcacggcatcatcaggctgtgcggaaagttgcagtcggattaaccgtttctgcacaaagtgatgatcaagtgattgaagctgttgagtctacacaaaatagtgaaatagtagcagttcaatggcatcccgaaaatatgtggcaagaatttccagaccaactagagttttttaaagatttggttaaacgtagccaacacaattaaagcgcgcgaaagtgaggatacctatgcatattgaaacagaaaaacaaaagatgggtttttggagtattgtcctgttagggattaatgggattattggttcaggaatttttctacttccaaatcaagcgatgaaactgatgggaaccgcaagtatcggtgtttttatttttgatgctttacttgtgacaagtattaccgtttgttttgcagaatgtgcttccttgtttgaagtaaatgggggtccatacatatacgctaaagcagcctttggtgaatttgtaggttatgaggtcggttttgtgacttgggcaattcgcatgattgctgaggcgacaatggcggttgcgtttgcgactgcgttaggcgggattgtaccaggttggaatacaccactgattaaaaatattattgtgaccgtagtgattgtgagtttggcactgatgaatatttctggtgtcaccctttcaaaaatcgtgaataacattgtgacaattgcgaaattattacccttgctgttgtttgttttgattggattctttgcaattaatggtaacaattttacaccgttgtttcctgggggaacttatcatagtggtgcatttgctgcagcagcagttttactgttttacgcctttactggatttgaaggcttagtggtagctgccggtgatatgcgaaaaccagagaagaatttgccacgtgctattttactggtcattgtgattgtaaccgtgttttatattttgttacaagttgtgtcgattggaattttaggacaacacctaagcgcgtcaacggcaccaattcaagaagcatttggtaaaattgctggtaattttggaactagtctggtggctgccgggacaatcatctcaattggtggtatctgtgtggcatcttcatttattacacctcgttcaggagtagcaatggcagaaaacggtattatgccggcaattgttggtcggcgtaataaaaagaatgccccatacgtggccattcttgtgtcggcaacaatatcactactgattgcttggtctggaacgttcgaaactttagctcaaattagcgtggtttcgcgttttgctcagtatattccaacttgtttggcggttattgtgtttcgttatacgcgggcacaggaactacgaacgttcaaaattcctggaggttggttaattccaatcatcgcaattttggtcagtgtgtggttgctgattcaggttgatgtgtcacaattgttatttggttttggggccctggtgattgctgtaccattctattggattatgaaaaaacaggcaaaagcataaataaaagagaatgaaaaataaggcgcattagattctgacgtaactcagtacacagaatctaatgtgtcttattttccatttatatttaaaattcttcataaactgctggatcttggttcttaacacggccgtctggacggtccaaattcgtgatggcttccatttcttctggcgttaactcaaaatcaaagatgtgtaagttttctctttgacggacggttgaacttgattttggaatgggcataacacctatctgagtttcccagcgtaagattatttgaccaacggatttcttatgggcatcagcaatttttttgattgtggaatcttgcagtacagaacttgctcgaccaagagggctccaagcttcagttgcgatatgatgatctgcatcgtattcacgttgaggtgcctgtgagaaatagggatgcaattcgacctgattgacggccggtgttacgccggtttcatcaatcaaacgatcaatatgttctggtaaaaaattagaaacgccgattgaacgaactaacccccatttttgggcatcaattaaagctttccatgcttccacataatgatcttcttttggatttggccagtgaattaggtaaaggtcgaaatattttaacccggtttggtaaagtgattcttgaatgttagttaaagcttcgtcgtattggtgatgacgtcctggtaattttgatgtaatcatgatctgagagcgcggaatatcactttgtcgaatggcctcaccaagtgcgccatggttctcgtaattataagctgagtccaaagcacgatagccattatcaagtgcactgcgaatagcacttacacaagttgccccatttaatttataagttccaaagcctacttgtggaaaaacggccccatcattaagcttgatttgtggaatttgatgactcattattgacatctcctagaatttaaaatagttgacattagacttgaacggttaaacaatgaaaacgttctatagttttaggataagctaaatttagctttcatgcaaaaatagcctatcaatttaaagaaagattaggtgaaataatgactgaagtaaatgcaaacaaggtgggaacactgacacttggagaaaaaacgtttagtcgcttaggatatggtgcaatgcaactacccggcaagtgtgtttggggggccctcagagaaccctaaaaatgctgtaatggttttacaacgagcagttgaactaggcgtgaattttattgacacggcagatgcttatggaccgttcacctctaacttactgattcgggatgcctttgcaccttacaagggcgaatataaaaatgtttttatttcaacaaaagtgggttttacacgccaagggcctgataaatggattccagttggtcgccctgaatatttgcgacaagaagttgaaatgaatttacgcacattgggtgtagatagtattgatctgttgtttttgcatcgaatcgaccccaaagtttcagttgcggatcaaattggtgaacttgccaaaatgcagcaagaaggaaaaattaagcatattggtctaagtcaagtttcaatcaatcagattcaagaagccagcaagtatgccaaaatcgaagcagtacaaaatctttataatgttactaatcgaaaagacgagaatgttctagattactgtgaaacccatcaaattatttttgttccttggtttcctttggcaactggagctcttgctaaaccaggatcagttttagatgggttagccaaaaagtatcaggcaagtccttcacaaattgccttggcttggttattaaaacgatcaccggtgatattgccaattccagggacttccaatttagatcatttggaacagaatgtggctgcaacaaatgttaaattaacagatgaagacgttaagggaattaatgacttgaaataagatattgataagtcggtatcataagaaaattataattactacaataagcattaaagttgtaagaacctttagaaatttgctatactaactgtgtaaacaaatcttgtttttctaagaggcgtttatagagacaactaagtgatcactagttgattttatgagtaatactctagacaaaaccaaaaggagtgaaggacaatgtttggatggctatgggctttaattattggtggaattatcggtgcgcttgcaggtgcgattacaagtagagatttaccagcaggatggattggtaatattgtaggaggactagtgggtgcttggttaggacaatcccttttgggaacatggggacctcagttagcaggaatggcattaattccctcgataattggtgcaattgtggttgtgctaatcgtatcagcaatttttggaatgagaaaaacaaaataaagagtgaacgaattgaaacggttaaacagctgcatttaagatcgatggaagcgggatcgcgatctcgcaggaatcggggttaaatgcggccgtttgtttcaataagttgtcctaataaagagtgaacgaattgaaacggttaaacaatctttttttgagtaagaaaacaagcgtatttccagctttttgctgaaaaatacggagagacccaaaagtacagcatagaaatgaaaatagtcttcagaataaaccgcataaaaccggcattctgaagactattaacctgtactgaaactataaaatggagtcggcggggatcgaacccgcgtccaagcatattgccacccagatatctacgttcataggcatactacttaaatttcactaaccaaaacaccgtatgtcagggttctcttgatcagctaatctgattagtctcttcaagctacttcagatgtgagcaacttgcgtaagtccacttaatttaagacctgtatccaacacatggacgatgctaggcagatctacgttaagctgttattaagcagctaaagcgtaagaattgttattattttttgcagttataattaaactgaacgtttttaacgtagacgtaaactacgaaacgcaatccgggctcaacctatacctgtcgaatccataacgaccccataacaacagtattactatatcacagccagttacaaaagcaattaactcgcttacttatgctgctgtgaaccagaattagttgcaggaatcaaggcaatttgtccgcgagaaaccattgtaaccaacagtttgttgacaagatccgcattctggacattctttaataaatattctaacaacgcatttttggtttttctcattgtacaatcctccgtgactcttcgcatttaaaacctaatcttaggtaccaataataatggttcccatcataattgtcaaccgtaaaacacccaattattttccaattttactaaaaactaaaaatataatgacatcgttttcaataaattgtggaaattagaatcattttgaactaaaatgaaggtaaattgataacttgggaggtatcctaatgactggtaattcaaaagtaaccgcaattttatttttcgttttctatttgattttaacttactttgtttttgttcatcaaaacatgattgcgatgtatatgatggcaatcggaatgttgctggaagccaccatcaatctgtggcacatgtttaaatcttaactaaaatcaggtacacttagggtaataaaaaacggaggagcattgttctatgtcgcaaatcagcgagttgcatcgaattgaattaaacactttaaaaaagttcgttaacatttgcgaaaaacatcacatcaaatactttctaattggtggttcactgcttggtgcaattcgccataacggctttattccatgggatgacgatgtggacattggtatgcgacgtgatgaatatgatcgtttttcttctattgcccctgcccttttgcaaaatgaacactacttcattcaaaccgcggacacagatcctaattttgcatttagctacatgaaaatgattgatactgacacttatattgaagaacgaaataatgtcaatgacgcgcgcaaaggcattttcgttgatatttttccgtttgataaagtaccacgacaacctgaaattaggcgagctgtttacagtcgttttcgttattttgatacacgaatccttttacgcttaggctataatatcatcaaaaccccgtttcgtaaggatccggaaactaacgaccttaatcactatatgtcagttgccaaactaaaagaaaaacgcgaaaatattatgcgtctttataataaggaaccatttcaccattacaaaaattatgcgtctcagtatgcctatgataaagaagttttaaatcaagccgaaatctctgagttgatcacccatccgttcgaagatattcaggttaagattccagaagcttacgatcgcattctaactcgcatgtacgacgattatatgacgcttcccccagaacgagatcaaaaagaaaaacacgtcgatgtgttaatcgtaaacggtaaacaaattgactaatataaaacgagagtgacgatctgatttacccacagaccatcactgtcgttttttgctttatcacgcaaattcaccaatcatgctcgcagtcatgataaaatgtgctttcattaattatctaaacattgtctttgttgctcttgccaaaactttaggttgtttttcataatgatggagtggtgttaactcactatcaggaattcccatgaagtgatatacagccacttgggcacatctaaatgaatattgttccgtgaagaccatgtcaaatggcatttcggcaaactgactgataaaagccaaattcttagagttctttggcacaacagctggacggtcccccacagcacgacgattaaacaacgcgctagcatacggcatgtaggctggaatgacgtttacaatgctgtccataatctcttcggtatgatcagcaatgttgtcacgcgctggatccacagccgctagatggcctaacagctcctctaacatctctttaccagtcatttcgataaatggtttgtcaacataatctcctttgcgacgtggatacatgacatagccccagaaaacagtttcattttccttttgaacgtgaaaatgaggttggtgatggacaacgattgacatcaaattgttactgtcaacccaagtattcagcgcatttcctggctcctgttgtgtaatccgagaaatctcatttaataagaaatgattattggttgtcacagtgaaacttaaccactcactttgtttacgatcggcaaagaatttgtctggattacccaaattgtagaagtgttccgttgcctgtttccaaagagctgcacttggcgcatactccatgttttctttaattggggtgtttaaatcgccaatggaagaactatccgtaattgcaccgttcgtatcaaagacaaaatcattttcgccaatttcaatctcaccgggtttgttatcgttatccacttcttcatacttcaagcctgttacaatgatgtcatcgcgtaacggtgtatctttaaatacaaattcagtgattttacgattatttacaaagttcacaccatgatccgtcaaatatttacgcattggtaaaatgatgctttcatactgattatatggtgttcgcgtcacgccggccaaagtattgattcgactgaattctaagatcattcgattcatgtaacgccgtagctccattgcagagctttctttcttaaacgcgaaagttgtttgccacatgtaccagaaattagttgtgaaaatatgaggactcttagcaaaccactgttcaatgctgacatcatttaattgtggttccttagattcaggcatcatcattaacttggttaataggaagcgatcctgattattaaattgcatatgattataatctttttgatcacccttattacgaatgccatccgtccgatccattaatcgcgcaacatcatgtgtaggatgtgcatggtcaaagttcaaaatatcgtccgtaactgattgtcctggattatccagcgatggtactgaacgtaaaacatcccataagttttcataagtttcttcgttcagcattcggccacccttcgccaagaatcctttattgttacttaattctgggttaccgtattcggactcataatcagctaccttagcaccatcattggcaccgtgtttttcaagaccaaacatggtaatttgatcaccactccagccaccgtcacgtattaaataaatgccagctgccagattaccaattcctgatccgatcatatatgcttttgccattatatccgcccctcattgttaaaatttattttttcgaaacacactattcataacttacgcatttgactcccgaattaatttcacaattcgctccaaacgctctaatgtgtcgtccaacgttaaatgataagtattttccaatccgtttcgcgtcgaatctacaatattgactgatcgcaaaatcttcaaatgatgtgaaactgcaggttgggaaatatctaactgggtcgtgatatcaccaaccgtcatgccttgtttcaaccgcgaccccaataaaataataatttgctgccgatgcttatcagctagtgcgtttaaaatatctaaatcatttataaactcatctaaagctgccttttgtttcggctccatggttacctcttccataggctcacctctatccatacatttaaatatttaaatccatgaatatagtaacatgctttgtactttttggcaagcgcttataaaacttgtttaataaaaagctgttagcatatgtctaacggctttttttgctattaggtgtccgtggggtcttgtttatccaaaaatattgtggctaatacgccgataatgataaaaacaactaacgccacgatcaacataaaccacgatccgccaccttgcacacttactacagcacctttgagcgccaattccatcagaatccaaataccagctactacgataccaaacacggcgcaatacacctgatgagcatacttgtgtaataggaagtttaaaacctttgccatgaggatcacacctaaaaacgcaccaatcataaagggcaataagatcactaccgatgaaaaagcttgctgagcttgatcaaattttctaaccagcataaacatcaccgtatctaaaagttttgcaactgagttataaatggtaccgtactggttcaccatcattagcataactgcaccggaaatccccggaatcatcatcatagaaatcgcaaagaatcccgcaaacgcaatgactgcccaatcttttaagttttgtaggtgactcattgctacaaaatcactcatcccttcgtttccttgatggctaactaacatgatgaatgcaaatcctaagatagctaaaagaccatcaaacaatttgaacctttgaaaactcacttttttataaacaaatggcaaaacaccaattacaaggccaataaagaatccgtaactcattactggaaactgttcgcaaagccacagcactagctttgtagatgctagaattccgatcacagccccaagcatgatgggtagtaaaaatttgatatttttaagtggttgttttcgaaaagatgagattgcctcaaccattctttcatatagccccaccacgacagcaaacatgctcccagacagcccaggaattactaaggcaattccaatcaggaagcccttcattgtattaataagcgatttcgattttatttgcgttacctcttttctttttaaatccgattgtcattgcaactttttttaattagaagtcatttcagcgatgtaagcttgcttttgggcttcccacttttgtttgtcatcatcgttaatttctcgtaacacgtgacacggatttcccaccgccaccacgttatctggaatatcatgtgtcacgattgacccagatccaatcaccacattattcccgattgtgacacctggatttataacagcgttgccgccaatccagacattatcaccaattgtgatgggatacccatattcatagccttcgatccgtaccgtagggtcaatcggatgcccagctgtatacaacccgacccgcggaccaaacattacgttatcaccgattgttatgcgaccaacatcaataaaaatacagtcataattggcatagaaatttttgccaattgtcgtgttaattccataatctgtatgaaacggtggctccatataaacgtggtcccccacactgccgaacagtttaccaagtaattctttgcgataatccatctgttcttctgtggtattgttaaacaagcgcgttaaaatccgactatgtttgaaatcttttcgaagttccggatcatttgcgacatacagtttactacttaacattctttctttattggtcatgacagttcctccgtatatttagtttgattatatcgaattttaaaccctgtgtcagttgataactgttgttatcactcattaagaattaccgaagtttaaccacctgaccacttttagccttattttgaatgctcaacacaatttttttatttaaagaagtaaaaacgaactttccaccatcctttccttgcagttttgaattatattttctttcccagcctgttctcccaacccgatcatgttcgttaagtgttggatctgcatttatctccccatcacttaccattcctaccgttcctatttttctattttgaccatgtcgtctgtcggttacatatcgatcaaccaaacctggaacttcaggttgtttaatcttatcagctgcttttaaaggcaagaaactatcttcattaactaatataaattgatttagtcttgtccgtaaggcattctctgataagttaaactgagaagcgattttgtgaatattctcttctttgtttggcgaatcattcaatttttccggagctataccgaccattttatgtacaacatccttagctaacacatttcccgctaccgatcttatttccccacgtgttgcataattgattttaacttgaagaatagtatgtttaacagtcacgttaggaattatcattttttcagaatttaaaattttccatttgccatgtaacttccatatctctccagttactcgattaaatctaattttgccaatttttgatttcatagccagttgatatgaaatttgataatgattttgaactcggtcaagctgtaaattctttaaatgaatatcttttgctcccatggcattaaaaatctgaaaatatttttgtgccgtttcttccaacgccatatttttagtcccatcatgtgataaaatgtccacaaaattttgtgactgcatgttctgatcataaacctgaacgaccctctgaatatccgctatttcatttctattaattacgtagtggacaacgacgcctaataaaaagaggataactatcatttttaaaagcaatctaaaactccttcgcatctgtttctccttgaaataaatatttttatattatctatcctttagaatacagaacttttacttaaaattacatccctatccgttctaaaacgaaagatttaacgctaaaggcttgtaatatttagttttgtgacttacagtgtactagataactattacactattacggaggaacaatatgaagtttgatgataaggttcctatttactatcagattaagcaatatatatatcgtgaaatcattattgaacatctcaaaccaggccaacaaatacctgccgttcgtcaacttgcagttactttgactgttaacgtcaataccatccaacgcgccttgagtgagcttattgatgaagacgttctcgtttcaaaacgcggtaaaggaaattttgtgaccgaagacacagaggtcttgaaaaatttaaaaagacgcactgtagaagaacaagtcagcaatctatatgataatctgacggctttgcggatttcgccagataaaatgttgacttatttagaaaattatattaattcgcgaaaggaagcaaatcatgactgacattttaactattaaaaatctatcctataaaagaaatttaaccaacattttgaatcaactaaattgttccttaccaactggcagcattgtggggcttttaggagaaaatggcgccggcaaaacgactttgatgcgcttgattagtggagccgcaaatcactatcgtggtgaaattaaagtctcctcagaaacaagccccagtgatcgcaagcagttggtaagctttagtcaccaagtagatgatgttaatagatctgatcgcttagaaaaaatcgcgcatttttatgaagctgtctaccctgatttcccaacaaataaattccagcgtttatctgagtttctaaatcttgatttgtcgtgacacttaaacgatttgtccaaaggaaatcaaatgaagtttatcatagcaattaccttatcacgccaagttaaattatatttactagatgaaccttttgacggcattgacagtatgagtcgtaaaaaaatcatagccagcattcttcagtggaaaccagaagacgcgaccattttaattagcgatcatcatgtcgacgatattgctaatattttagacggcatattaattgtcaaagataagagaattattgtttcaaagaacgctgataaaattcgggaagattacgggcaaagtatcgaagacttttttgaaagtttttataaaggagaagatcaaaatgactaatacaagtgtcttaattaaaacactatttaaagaaaaaaatactaccgttcacaaaattattggcttacacgtccttacccttttgattacccttattgcgatgattttggaaaacgaatttaatagtattaattttgcaaatctttctcttgtatacggagggatcggagcatcaaccctatttattcgttttgcgctacgcattgaaaagatgtggacgagtaacacctatcgccttattcccgtttccgaaagtcgattgtatgctgccaattttttatctgcagtggccagttttgtctattttttaattttggaagttattattattggggtaagtagtattaaacccttatcaaccgttaaattacccacacacatcttgctgggatactttgtatgcgggttgatattcatgatcatgttagttcttacaggttggacatttaattgcctagctcatcttatagaaaacacgattagtaactttttacctgacaagtggcaaggcttgcttcaaagcctactctacgtggctacatttatccttttgctaattatcctaagtgtacttaataatccaattggtacaattataaataaactattttcaccactgtactcggctagcacgccgcttaacatcatttttactttactcatgactagtgtattcatgctcctttggacagtagttctgaccatccccaatctctatttattaaaacattgggtagaaaccgaataagctttaaagtcacaattaaaaacatcttcaaccaactcgtttcaaagcttagtgaaatttttaattgcttcttatatgttcctcatgtcattaaatttaagattctttgtctcgaagatacccgcttttagtcaaaaaaaaaatgtaacatgataattgcgttacttctgataattttctgggtacgattagagttgttaggaggaagcatacatgaaattttcgactcaattgcgtgaaagaagaaaaaaactaaaacttacgcaggaatctttagcaaacaaacttaacgtaactcgtcaaacactttctcgttggaaaaacgatttgagttatcctaatctagacaccctggtccaaattagccagattctaaacatttcactagattgtctgccaaaggaaaatgaaaactccatggttggccaaattagttcaaatgtccgaaaaaaacgaaaatataaaactgttctattaataattggacttctattgatcgccacttttgtattcataacattcctaggttacggtcgggccacacaaaacgccacgattgatcatctaaatccattcattaagactcaagatggctatgcaattttacccaacctggcaaatcaacaacaacttacacaacaagtagatgtatttgtctctgacgacgcatttggtaaaggcagctggctaaaatttgagacaggccaatataccgctaaaaatcgctggacattaattcaacataacgaatcctatatttctaaagtgcgtttgctaaacaaaaaacagattccattaggcatgcgtgagcaagctggcagtttttatactggctatcaatccaaaactgaaggcccaaaaatcggcaaaaaaatttcgtggtggtgatttgactaattcttaatttcaaaaaccaccagtcacaaaaaaacgttatgcccatttaaaatgagcataacgttttataatgcaatttatttggaaaagcttcatcacttagagattttgatgtcgaagcccttgtaaagcgataaatccaaacaccagaatgacaataacttcgataacactgctggccaccgtgtcaccactaaattgttgtgtaaaagaagaattactagtaaatagagtattaataaacgaagtaatcacacctactagcatgttaaatccaaaatacagcaaaatactcaaagttttaccttttacaataattactgaagtcattaagataaataatccggcaatgtaactcaaaattgcattaatactcaatggtatcatttgaggcaccatcagcatccccatttcaccaaataactcatcccagccgccaagattaccaacttgataaattagagtagcaacaggtaccactagcaaaacaaagctgacgacaatatttgctaagataaccgctccaattttagcgaaaaatagtttatttcgattcacaccagaagcgaccatcagggctaaaacacgattcttataatcaatggcaagtaagtgaaagggataaataatacctaagaatatcagattactaacaaacaataggattgctaagacaatacttgtcaccagaagtgaagaattaaggtgatcgaaatttaaaagtgcaattgttgcaatcacgtttaacccaaataggattaaggtcgccattaaataatatttgtcccgtaaatatttaaacagttccatcttaaaaattaatcttgcgttcattcgtcaacgcctccttgctgatccaaaactgatacttttgtcatagtagtaatcacaattgcgtgttccactaattgaggatataaattttgccatgattcagaattaatatcaatcttgacaccagtctcagttttaacgaaattaattgattctgtggtcaacaaatctgcaaaagcttcgtcattattagtcgaaatattacgataggcttgttgactatcagccttcaaatctagtgctttaatgatgcggccatggtctatcacaaaaacagtttcgcataagctttccaaatctgtttgaacgtgactggaaatcaacaatgtatgattgccttttcccgtccattgacgcaagtagttttgaaaccacttaacggtatcttgatctaacccacggaaaggctcatctaaaattaagacctctgccgaattcacaagagctatcagcaacactaattttttctgcataccatatgaaaaagttttaactgggcgatcaagcacagataataagccaatctcatcagccatttgttcaacttttttcacatcataatggccacgcagtccggcgaaatattggatattaaagcgggccgtatagtccttgtaaaccgaaagatcatcaaggacaattcccattttggtcaaaattgaattttcttttcttggattacgaccatcaaaaataatttccccagaataatcggtaataatattagttaagcacttgaaaaatgtggttttacccgctccattggctcccactaatccgtatgtatgacctggttcaattgttagttgatcgatatctaacgctttaaggctaccgtaacttttgcctaaatttttaactgtaatcgtcatcccatcatctcctcatattatgtttttattatagcaaaattacgtctcatttacactattatttcatatatagtggtgcatttaatctacaatttttaatcattttgagtctgaattaagatatcatttttcactaaaaaccataaagagctctgaagaatccttataattcttcaaagcccttctattttcttagactacgaactaatttatacttcactaaaatcaatatccaattctgcagaagctgctttttcttccttcaaatattgattatctaacattttgataaatggatagtaaataataattcctaaaataatttcaaataattgtaaaactgaacctgtccagcttccagtagatagccacccagaaataatcgggggtgtcgtccacggcaataagacgccgtttgtatgtggcacccatccccaagtcataactaggccagaaatcagagtgtttaaagttggaataataataaatggaattgcaataatcgggttaagcacaactgggagaccaaaaataatcggctcgttaatcccaaaaattcccggaataatagctagcttgcctaactgacgcactcgatttgatttacagatcaccagcataacaattagtaaagataatgtacttccgccaccaccgtacgttgtaaagatatcaataaacggctgtgtaaaaatgtgtggtaattccaaatgcttttgaaaggcctgtaaattatcctgcgtcaaaacaaagaaaatcggcgaccaaactgaattagtaattgtggggccgttaattccaaagcaccaaagtaaacttgccaaaaaattatataaaagaacagacggcaatgaattaccaacatttttcaatggagcttgtaacatggtataaatgaaattgtaaacggtatcaaaactagttaaactaaataaaattcgaacaagaaaaaatgcaaaaataactaaagcactaggtagtaaagcatcgaatgattgggacactgccggtggcacaccttcgggcattctaattgtccaatgccgtttcaaagcaaaacgataaagctctacactgattaaggcaataaagatccccagaaaaattccattaggtccaagataaagagtttcaactgcactaacagttttcttaccactgtcaatgtggtaggcgtaagaatcaagaaagaaatgattgcaactgcgctagcattgacggcttgcaagccacggtttttagcataggcgtatgaaatcccgaaacaacctagtaaaccagtaaaactaaagactgagtttgatactgaactgaaccattcactccaatgagagcctaaaatgccagtccagaattcactccagccagggattggaaagtttccaatcaataagaaaaatgaagttacaataatcaaaggcgtgataattaagaatccatcacgtaacgagcgtagcacaacgttattacctaattttgttgcaattggcattaagatcttttcagctttattttgcataaggttccctccattctatgaaaaacagtattgtgatttaaattctgtcatatctgctttattcacggacaactcacagccctttacaatagcctttaatgaatcagataatcccgtcccaccttttttcggtactttaataattgttaaatcttctttatattgtgtaactagctcttcatttttctcaacagcagtggcaactagcactggaatagcagaattcccctgaaagtaagttgctaattcacaggccattgtcgaaaattccggatagtcatacgtcggtccgatgacaaccacatcagcttccattttctccgccatcttagtaaatttactttgaaccacctcggcatttttatgataataatcggttccacaataaaaagttccaataacttcaccattagcctttttcagatttttctctaaagtttccgcactgcccattgcaattcttttgccacccaattcagtatccgctcgttcttttccacctaatcctgattgaatttggtctaaaatgacaatcactttcattagtgttccctcctcgctctgttttaatctacaggggctttaattcgcttttcgtatgcatccaaccattcttgagtaattggttcaataacagtagtttcgtttggtcccgggttggccatcaaaatttgtggctgttcattttcatttcccacactaaaagtaaattcaacgttggtggcaacaccccactcacctttgtggttcatagctaccaatgaaaactcaccagctttcccgtaacgctttttcaatttctcaataaatggataaaccgcttgatcgcaagcttcttgaggcgttttaccgtcacccattaaccttacgatttcgtaggataaacagcccttcataatgtcttcacctagaccagttgcagctgctccaccaatttcgctatctacataaaatccggaaccagataacggtgaatcaccaatccgaccagcctttttcatgaatagccctgaagttgaggtaccagcagccatagatcccttctgatctaacgtaatcgcgccaaccgtatcatgaccgttatatggatttaaatttttttcacgaatttcttttaatcgtttttgccagatctttcttgcacgtggggttaacatattcacaatttcaaaatcattttgcattgcatattgagttgctccttgaccaacccgaaaactgttaaaatgctgatcacttaacttacgggccacagaaacagcatgtttgacattttgaatgccagcaactgctccaatcgcgagactatcgccatccataaaagcggcatccatttcaacaacaccctgttcgtttggtaaaccaccgtaaccaaccgatttataatacgggtaggcctctactgtattaatgagtgcctccactgcatctccagctgcaccttgagcctttaataatttactcgccttcacaaccccatcatgggccattctccaggttgcaattgttccgtatgtcatctaatcatcctttctttttcctaaaactaatattgccttcatataaatttccatattggttaaaagatccttttcatccatatactcatcttgtttgtgtgcaatgcctttttgaccaggaaacgaaggaccaaacgcaataatgttcggcaccacacgggcataagtagctccggttgtcgtaactggggtgccatctaatccagtgacctgttcataaacttcagaaatccgttttatccaatcagcttgtttgttatgcataacccctggcattgagcgcacaatttgaactttactgtcaggaagaatatattgtttgatgccttgcgtcacctgttcttcggttatcgaaaccggatagcgaatcgcaattgaaagttttaatccattcgcgtttttctccaactgataaggcgtcataatcaacttgccactatctgcgtcttcgaattcaactcccagtttttgtccataatgttgatcgtgtaatcccgctagccaatgaaaataattcataagttgaccactcagcaattgattatcatcaattttcttagctaacaaggttagggcgtttttacccaattccggcgcattagacggcgaacgtttccccacaatgttaatcttttcttgatttatcatggcaatcactgaatcaggaacgtgatcagatgcttgttcctcgggattcaagatatcaaacatctgaagatcagctggcagaataggcgtttcaattgcatagttcacaattcctcgttcaccatacacagccggatatttacagtctggtgtaaacccataaaccggtgcaggtttcttcgctaagtaccgtttcatgtcagcgcttccattttcttcgtcagagccaaatactagtcgaatggtatgcgacaatttaatgcccatgtccttcagcaatttcattccataaaggcaggccatacttggccccttgttatccaaaatgcctcgtccataaaatcgttgatcctgtttgcttaactcaaatggtgccgttgtccaatgactaccagcaggtacaacatctaaatgaccaaatatcccaatgtagtgttcatcgtcgtttccccattgtacgtatgcagctgcatcatccacaatgcctgttttaaatccgtattgctttccaatttgtgtaactaatgtcaaagcttcacgtggcccttcgccatagggtgcgtgttcctttggactacttttaacactctccacgcgcatcattttttgtagatcttgtagaaattcttgctcttgatccgcagtcaatacatgtatttcttgagtcatccttcaccctcctcaaagtttgtggcgaatcaacgtcgttttaaaacgatatttgtcggcacgataataagaagtatctaaaaatattggtttagcttccgcggtgtacgtaaccgactgtacctttagaatcggaccaccaactgaaacatgaagtaattttccaatatggtctttagccaaaacagcttcaatttcttgttgagaatatgcaattttttcctgtttctcaataattttaaacagcgagcctgtaaaatctttttttgacaatccttttactaatggttcaggtatatatatctgttcaactgtcattggttcgttatcccaatagcggcatctaaccaatctatacactgaaacttcgtgattcttgtttatttgaagcatatccagaacatttttagacggatggcttacctttgcataggaaatcacttctgtatgactatctctgccatatgcttgggatgcttcagtaaatccttgaagtcctaggcgtccactttcgattttaggtgcgtcaatcacataagttccctttccttgacttttaaccagaacctgagattcaattagtagcgcaatagctttacgaactgtcaagcgactaacttgaaattcatcagcaagatcatattcagaaggtaacttttgctttgtgccatactcaccatcatccacgcgctgtttgattatatccgccacataccgaaattttgcttttctcatgccacacctccaatttaatcaaactagtatgtactgtttagtatatactagcatgatacatgcaaaaattcgagaaaaatgatgctacgattactattaaaaaaagcactcgcaaactaacagtttacgaatgctaaaaatgattatctagcaaatttaacttttacattataaaagtgcaaaaccgatttcagaactctttttactatagtttatcaagaatttattgtgtcaaatagttttttacgaatttacgtgttacttaaaatcagtaattcttacacattcgtcgacggctgccttcacttggtcatcatgagttgcaataataacgatttttcctgaattcgccatttcacgtaaactatcaagcactagttgaccattggcgtggtccagtgctcctgttggttcatctgccagaacaatcaacgggtcctgtaaactaagtcgtgccaaggcaacccgttgagcttctccaccagatagcgtaaatattttacgagttaaataggtatcatctaatccatattttgacaaatgttcttgtagaacattggttcgataatgtttcacaatattaagattttgggcaacagtttcttcatcgacaagcgcataattctgaaataaataaccaatataccgacgaaaatatttcaaacttgggatagttttgatgtctgtatcatcaaaactgattgacccactggttaatttttctaatcggccgacactattcaatagtgtcgttttgccacttccagatggcccaacgagtgcgtacattttgccagtctcaaactgatagttaacgtttctaaaaacatgatactgatcaaagcttttactacatccactaagttttaagtaactgatcattgtcctattctcctttaattgctttattaatgttcaaataacggttttgaatacccaatattaacaattcactaacattggatagtactagcaacagtatcataaccatcatattgtgggtcactgcccacacgacgaaggcttcaaaaaagcttaatgcaaaattcaagacgatgaatttcccaaagataccaatgaagtggctccccaatagtcgtttaatggctattttcttgcgattgttactaaagtaaatgctattaaacgaaatgttttcaagcacaatgattgctagtataataaccaggaccattattgagattgctagtttgcgacgaactaaggctagttgtttcattgcatagctctttgtgttaacaatgccaccgatgtaacgagacattcctgatttttgaattcctttccgcatgactgcgacacttggactaagaaaagcttcagttgagaggtagcttgaccaaatactatttgcgtctgtatttttcttactgattccacccaaagattcatttgttaaaacaaggacaactgcagattttacatagccattataatagcccatatccagtgcatccgcactgtaagtaaacaagtgctgtgcatttttaattttgattggcttaatgagcagtttctttccggttttattttctgcactgtttagccatagttcgctacgatactcccgcaaaatttgtttacgattggcatattgtgcttcaggaattaaaacgtacgttgtgcttgttttgtttgatattttaactcttttaccattcgaagcaaaaactgaattcatttttaaataattggggtttacagtcaaaacatgaccatttgtagaactcataacatccgttttgtcagttccccatccttgataggtcgcaagcatccctccatgatttgctaaataatggaatagagtggtagagccatgttcaagaaatatatcttctttttttgtagtattaattggagaaatgttgatagtatagtaagtttttccatgcatccaaactgataattgatcacttaattgatgattctgttttagtgttcccagtaaagtcacgaaagtcatacaagcaaatatttccacgacaattttaataatcatattaatcggaaattacaagaacaagttagccaccccgcaggcgaagttgcggggcttcttagattgtttagattgagatggaaatgattttaattttgtaagtgacttgcggcgcggagacagtgacaatgtcgccggaatggtggttcagtagtgccgaaccgatgggagaggcgattgaaattttaccgtggtcaatatcaacttccggcgtgccgacaatttcatacgtttcagttgagtggtcatccagaaattcaaatttgaccgtcttaccaacttccacggtatcattgttcgatggggtataaacctgggcgtactggagctgttttcgtaagaatcgcaatcggctctccaggtggcgaagatctcgcttagcggcactgtactcggcgttttcggaaagatcaccaagcgctcttgcatccgccaaacttttgatcttagcgggccgggaattttcaagctcacgaatttcagattcaatttgttcgtagccaaacttggtaattttgttgaaatgaggttccatgaatgtatccctcctgacatttttaagtatacaacatgtctaaattatagccaattaaactaattacttataaaaatcggcgaaatttccaacatttttattgaaaataacggcgatttagtcgcaaaattaccagactgaaaccttgttttataagcgtttgttgatgatatgttatgggaatattaccaaatccctatttggtttaacaaggttgtaattttctggacacgtctctgtaaataggttggagtatatttttcactgttgattaaacacgaaaggaaaaatatatttcatgagacttaaaaagatcattatcgcattaatgactgcattaactttctacggcacaatgaacgttgccgcatccactgaaatcgctgaagctaaggctactaaagtatacaaatcaaacttatcaaaggctaatcaaaaagccaagaactggatcgcctaccacgaatcacgcggttcataccatgccagaaatggccgctacatcggtcgttaccaattaagcgcttcatatcttcacggtaactactcaaagagcaaccaggaaaaagttgctgaccattacgttagtcagcggtacggcagctgggtcaatgctaagaagcattggaaggcttatggctggtactaagctataatacgaatatgttaagagatcaaatgatgaacaacacttgttcattgtttggtctttctttttgcttattgattgaatttgagcctccttcaaaattgtaaccgctgtaatgaaccattattcggaatctccgttgtgattcctcaaaattcatgttaatataaaattattgttttaaacacgaataaaaaggagaacataatggaaaatgtttctgttccaggcaagaaatcacctgttcgtaatgcaattttaggttttcaacacttactcgccatgtattctggcgatattttggtaccgttattaattggtggggcactgggattcaatgccgctcagatgacctatttggtatcgatggatattttcatgtgtggcgtggcgacattgcttcagatccgcagaacgccgattaccgggattgggttgccggttgttctagggtgtgcggtcgagtacgttgcaccgctacagtcgattgggaagaattttggcttgggttatatgtatggcgggattatcgtcgctgggttatttattatcctcattgccaagccatttgcgcacatgcgtaagtacttcccattggttgtgaccggctctttgatcacactgattggttttaccttgatgccggtggcttttcaaaacatcgggggtggggatgccactgccaaagcatttggtaatccgacgcacctattccttggcttcttcacagcgcttgtcattattgtcttaaacatttgggctaagggatttttgaagcaaatttcaattttaattggtatcttggtgggttcaattgttgccatcttgatggggacggttgatttcgccgccgttggccaagctcactgggctcagttgccacagttcttctactttggtgtgccgaagtttgaatggtcgtcgattgccaccctgattttggccgctttcacctgtatgatcgaatcaaccggcgtttactttgccttaagcgacattaccggccggaagttggaagaccgcgatcttgaacacggttatcgttcagaaggaattgctgccattttgggtggggtctttaataccttcccatactccactttctctcagaacgtcggaattgttcaactttcaggaatcaaaaagttaacgccaatttattactcagcattcatgctgatgattttgggattgatccccaagtttggcgccatcgcaacattaattcccgcttccgtattgggcggcgcaatgctggtcatgtttggaatggtgggtgctcaaggaatcaagatgctctcacaagtgaagctcaataacaagaatctgctgatcattgccgtttcgatcgggcttggcttgggagttaccacgcaacccaatttgttccagtacttaccagcaaccgttcaagtaatcatgagtaacggaatggtggtcggaagctttaccgctgtgattttaaacatcttattgaaccacacagctttgagcaaaaaagttgaagaataatttaattaaatcaataataaaaggccagcgagttaatcgctggtctttttttggttaacgactgtctcagaaattatcgttttggaacgtattcttcgacatattcagaaatgatattaagcaaatcagtcactggttctgacgtctgtttgttcttgatgaatgaaataccaaagttggctgtcaggacatccgttggaatctcgatgacgttgatgtgtttcttctgttcatcagtcaaacgacgtgggttggcaaatggttccggcgtgatgattgctccgacatgttccaatgcgagatcggaagccaagtgcaggtcgggaacttcgacgctgatttcagctgaaacgccaatgtcgttcaggaagctggtgaccaatcgttggtagttatcttcttgcggtgtaccgatgaattcttcacctgaaagcttggtaaggtcaagatcttcataattcaagaagactttatcaggatcatacagcttggaagtttcaggaataattaaaaccaatggtaattgggcgattggtttgtattcgaccttgtggctttgaagcgcatggccaatgaaaaagtcgagggttcctgacaagagccgtttttcggcgtctcgactggtcattctggtgatttgtgcatgaatattagggtacttgttatagaaccggaccagaaccggtttgtataagtcgttggtcacaacctcattggaagcaatggttaaatggccgtatttgaactgtgacaggtgcgtcatttcgcgatccaagttggctcgcagtcggttttcttcctgtaaaaaagccagaagtcgttcgccggcgtacgtcagctggattggatgagatgatcgatcaatcaatttaacaccaaagttcacttcggcatttttgataacccgactgatataaggctgggtaacaaataatgcctgggcagctttggacatatttccttgtgccttgatttcttcaagaaacgaaagtaatttgctgttcataatgtaattctcctttgaagacctctcgcctttagtttatcttctaaccagattatatgatattctagtaatatatgcatgaatagtgacttctaatgttggtattccacaaaaaagctacaatcaagtatagcaattccccgtgcgccagtaaaggacatgaaccttttagcccgggtattatagtaatcttaagatttcattatttatattaccattaggtactagtacctaatcgttatcagtgaagaaacaaatcatgcttttttctcgttgaatggtaaaatagtgtcataacttttatcccttaaatggatacatagcctactagaagggagttatcacattgagaattgaacaatcacctgaatttcaaattcatttacaaaccttaagaagcaaggaagaattatttctcgaaactatttataatgtcggcaatggtcactttgacgtccgcgactccaatccgctccagggaaacaaccatgattatattggctccccgggcttatttattaatggcttctttgattacgaagaagtcgcctatggtgagaagtatcgtgggtacccggacaataaccaggtaattaaccggttatttgatccacgctttattcgtatcaaggtcggtaacgaagattcgttgaccgatcatttcaaagttgaaaatattgataagaacttggacatgcagactggactgctgcacgagcttttcagcgtcacgactcctggcaaccggaattttaatctggtggttgaaagctttgccagcctgagcaagctgaatgtatacggagtccgatattctgtgattccaaccaacttttccgatgaaatcgaagtgatcaaagttcacgattacgtcaaccaaactgttcaccagcaggatgaagacgtccgcgtcagcactgatctggggcaaatgcagctggactttattcctgataacggccaacccagttacttggtaaccacttttcgaagccagcagggagcgattatcacctaccaagccagtgagaattttgccccgaacccgccaattgaatatttcagagacgataatcatcactacggttatcggagtaaatattacgccaaatcgggcagcgccaaagactttgaatttttgtttgcgattggcgatatccatccactggtcaatgccaatatgtattccgatcagtacctgtcatcgctgaataattacattaatgacaccacgttcaaatcagaattgatggcttcggcacaagtttggcagactttttggctccacagcgacgttgaaatcgatggcgatcctgctttgcagctgtgcgtgcgtttcaatttgtttgagcttaaccagtcagctgggcgagatgccttaaccagtattccagccaaaggactgactggtaatggctatggcggtcatttcttctgggacaccgagatcttcatgctgccgtttttcacttacacccaaccggaagttgccaaggatctattgatgtttcgctatcacacacttcaaattgccaaggagcaggccagcgactttggtcttggcaaaggcgccatgtatccctggcggacaatcaacggttatgaatccagtgcttactggctggcaggccaggcgcagttccacattaacgctgatattgcctttgccgtcgaacaatattatgagattaccagtgacgatgactttatccgtgattatggatttgaaattattttggaaactgcccgattttggatggagtacggcaactatgccgaacttgacggcaagcgccaatttgtcctcaaccgggtcaccggtccggatgaatatagtgccttagttgacaataactactacaccaacgtattggcccagagtaacctccgtttggcagtcaaatatgttcgcaagttcaagggcgacgacggcattttgagtcgacttcacgttactgacgacgagatcgacgctatggaaaaggccgccaatgccatgtatctgccttatgacaaggagaagaacgttaagctgcagttccaaaactttgaacagcttccgaaaatggatatttctgccattgatcaaagcatgttcccattgctcttacactatcatccattaatgttgtaccgtcaccaagttaataagcaggctgatacgatcatggttgattttatgttccctgaaggcaacaccttggatcagctaaaagccgactatgaattctatgaaccaatcactacccacgattccagcctctctaaggcgatctacgcgattattgcggctcggatcggtaaggatcagcaagcctacaacttcttctctcaggccgttcagacggatctgatggatgttcatcataatactaaaaatggcattcacgccgggagtttgggcgctgcatgggaagggatcatgtacggcttcgcaggaatcgtcaataatgcgacgagttttagcctcgagccccatttaccatctacttggaactgcctgaagttcaaggttcatctctatgggaatgaatttaaatttacgatttatcaagactcggttgaagtcgagctgctgagcggtgaggggacagatatcaccgtttatagccatcgtaaacacctcactccggacaataaccgcgaaacttggcaatactaaatttttttgaagaaagtctgaaatattaacgtcttttttggaaaacaggcgaactttggtttatgatttgttatgatagtgttatgcaaattcatcgttgattgctgaatatttaaacaagcccttgatcgttttgggcgagtcaatttatctgatgtgaaagggatgcactttataatgaagaaggaagctcgtcaatccaaaattgagcagattattaatcaatataccattacaacacaggacgaactgatggagaaactgaaggtggctggtattagcgtcactcaggccactttgtcccgggatatccgcgagatgcagattgttaaacagccggatagttcaggcaactcacgctacatgatttttaagtcgggtaaccaaaatgaaatcgagcggatgtatcggatgattaacggcacggtaaccgacattcgccagattcagtttgtgaacgtgattcacactcagcccagttatgccaacccattggctgcggtaatcgatgatctccacatggaaaatgtttccggaacgttggccggctacgataccattgtgactttcagcccgtccgtagactctgctcgtgagattaatgatttgtttaccaagcacgccaatccagacttgctggtttcttccattcaggatggggaataggcattcataatataaaaaataaggctttctcagctttgaggaagtcttattttttgtgctggtaattattttgcgaatcgtcgataaatgcgtcgaccaatcgccccaatcagaaatgccagccaccaaatgatgccgactgcggtgaccagtttgccaagcgcgagtcccggcgtttgatatttcagtgaaacaaagtggcggccaaccggaattctggcacccacaaagccgtgattgaccttgaagatgtccccggcctggccatcgatctttagatgccaaccggtggagtatggaattgacgtggtcaatatgcgggtgcgctccgttgcatccgtatagccactcacagaattattggtgactttttgactggtcaaaccagctttttgaagttgttgaatgcgggtgttgtactgccggttaaatggtacggccatcaacttgacactcctgaacttcagttgcttaacgccattaaagtgaatcgtcatcgacttttgcagattgtcggcgtaacccagattcaaaacaatgtgttgtctatcctcgtaatcggagaggttgttttccggtaattgacggacgtaagtgaagttgttgggggtttgaaccgacaatgtgtaagcaccgagatccggatgctgcagagcagttctgatacgatcaattttttgcagtttggaaaccggggtgccatcaataatcgaatcggcagtcaggctgttcagtcggtctgcagtggaatgagtggtgtgggagatgccatcgatcaccagatacaactctgaatgacgatatttttctggctggttaatgtttaattgatatgaaagatggcgtccctgcgcatcattatccatcagatgaaggccgttggcatttgcagcctgattttcggcaacgatccggtaattcttagccagcacactttgtagcggcttggcattgggattgatgccagtggctttctcccagatccggaccttgttggccggtaaagtggtcttgtatttcttcgcggtatcacggtagcgggcgtttggtgaaatccgcagccgatccaagacagccttgactgggttattggcgatgtgttcgtcaaataatcgtgtcgtatacggcacattttgaatgttgttctgcggttcggtcatcgaaacgccatcaaccggcttttcaaccacagcccccgataacatagcctgttcacgttgaagcggtgacatgttgcggtagttggcagctgaaatgacatatttttgtgtatagactaacggcaaagccaaattggattttagcaaaatcgtcccggaatggttgcttaacccgctcaccggttgttccgggaagtcgacaattttgccgtttttcccgcgaacataatggaacccatagggaatggcttggggctttttgacaatatccgttttggcaaacatgtatttaacacccagcaggttcagcagggtggttctaccatctgcttcaccaagcacggagttgaccaccgcctgtgaattatccagtgatctgctgaattgaaacaggctgccgttttggatggagtaataagcccccaagtcatgggttcccaagaccatcgggatattgttgccggcggttcggtggggatagtagttgtgaatggtggttgttcgatagaagccaccgttttttgccaacccattttgagcaccatcataatacttgtgaagccactgttcagccgacccggatgccaggttggaattgatattcttactattattggggctgaaccagccttgcccggcactaatgacgttaatgaagacgagtccgaccaaaatggtgccaacgtgcctgggagatattttaagcgacgtttgacaggcaaacaatagtagaaagctcagcaataatccgtaagataccaaatcgttttgcggtaatttgagggtaaagcctttggtgatccacacgagtacaatcaagccggcactggcgccaatcaaccagcgcaaatcgttttgagtcaggttcttgagttgatcaaccagaatcatcgttgccaagctcattggtaacacgatcaggaacaaccagcgattggacggtgttgacatggcgttggccactgcactaaactgcggcagcatcaacgcaatgatcgttaacgtgataatggttgccagtgatcggtagcgtttgaaatgtctgaggacgtacactgctccgagaaatgtcaatccgcagaaatttagcaccagccagtaatccttggtggtggtactggtgatcagttgattgggcatcgccagatagtatttaagtggataaagaatcagtccgttggcaaacttggcatgataagcaattcgagttgattgaaaaacggccaataaagttggaatcaagatgaccccagcagtcagcaggccagtcacgacaccctgcaccaaaccgtagataattctgccgttcttgagctgctcagggtggttgtgacggatgttgaagtatctggtcaatagatagacaaacgtcccgattgccagcatataagcgaagtaaaagttactgatgagggccaaggcaacggcaaccgccaacggcagccagttctgcttgtggagaaccttttcaatccccattgccaacagcggaaacagaatcatgggaattaagaaaaatgggtgatgcatcgagacatagaagttgtagccggaaaatgtataaatcaacgtcccgattaatttactgtgggtgctgaaatcgcgctcgttggcccaagccagaaatgacaggccgacacagtaaagacgaagcaagattaagacttgaaagccgagctccagcttggcagccgggaaaagggcaatcaggtagctgaatggatcaccaattatgtaaaaggcaaaggtggtgagttgatcggccccagctccaaggttccacgaccagccgctcattgcctgatgggcggttccttgaagcattcgctgaaattgcgccataattggaaaatgttgggcaatgccatcgacgttccagatcaaagttttgccggccagccagggaatcgtgtaggtggcgaggcagacaagtagaaaagcgatggaatagatcaaataagttcgaaactgaaaagactttctgcgagtatcaattctcggttccatgaaattacctccaatacatatcccattttgcctgcattgaggccgatagacaaggctattgacagatttttaatgtttgtaacattgacgccctcaagttgaaacaatgtgcatgaacattcatcgatgaattttagtaagctgagtaaaacgcttacatagccactgatttgttcaaatccggtcccagcaaaagtgaattttcttttaccaaactgtgaatattttatgaagtcgaaacatatttataccaaacagatgagaacaaagtatgaatgttgtgaagaaagtgttatagttagagcattcttaaatctaatcaaattcttatgttctaatttaaacattttgttttgcataattaaccgctaaaagccttttgtgaaaggaataattagcaggataatttataaaatgaaaccgcaatcattttcggccttaattgtgtgagttttttcacgttcacaatgtccaaaaatgtacggtaacctttttcaaaggggttatgatgtacttgtattaatggaagaggaggtaacaaaatgacaagtccaattcatgtaacatcggaaatcggtaagttgaaaacagttttactgaaacgtccgggtagagaaattgaaaactttacacctgacatgatgccccggttattattcgatgacattccatatttaccaattgcccaaaaggaacatgactactttgccgatactttacgcgacaacggtgtcgaagtattgtacctcgaaaaattagctgctgaagctttagacgcagctggtgacaaagttcgtaatgatttcttagagcaaatgctgactgaatccggatatgcaacaggaaccatccatgatgcattgaaagaatatctcagcagcatgaacaaccaagacatggtcaacaagatcatggagggtatccgtaagaatgaagtagatttcgtgccaacagacttagtaagtgctgctgaaaccgagaactacgaattctacatggatccaatgcctaacttatacttcacccgtgacccttcggcatgtatcggtaaaggtttgagtatcaaccacatgacattccctgcaagacaacgtgagtcactctttaacgagattgtcatcaagtatcatccacgttttgctgacaaaggggttcatgtatggcgtgaccgtaaccacgatacccgtatcgaaggtggagacgaattagtcttgaacgatcacgtaatggcaatcggtgtttctcaacgaacttccgctgacgccattcaagatattgctaagagcttatttaaagaaggtcactttgacacagttattgcgattaagattccgcataaccatgcaatgatgcatttggatactgtgtttacaatgattaactacgatcaatttacggttcatccaggaatccttggtgagggcggccatatcgacacttggacaattactccaggtaagaacggcgacttgaacttggaccacagaactgacctcaagcaagtcttgaaggatgcgcttaagctggatgatttggacttgatcccaaccggtaatggcgacccaattatcgccggccgtgaacaatggaacgatggttcaaacactttggcaattgctccaggcgttgtggtaacttataaccggaactacgtttcaaatgacttactcagaaagcatggcttaaaagtgctggaggttatctcaagtgagttgtcaagaggacgtgggggtccacgttgcatgagctgcccaattgttagagaggacatctgagagcgcgactaggcccgggttgaccccggagtgtaagccgggaattttaatgatgaacgcctttagttcatcattggaatttttggcttacacagttaggggtcagggccgtcgccaagtaggctaggcaggctttcagccggccgtcggagcgtgtttacatcagagcgcgacgagcaacgggtgaggcggtttctaagggtactttgcttgaagtccctgggtttgggactttaagcaaagtgcacttagaagttagcctcagttgcgtcgaagcgtgattacgaggcttcctcatccaggcagctgacaaaaaaccaccaactcaactctactctacaaacaattaaagcaagtgtaccgtacccaaaaacaatcatcatcaaggagaattcgattatgacaaaagatttcaagcaaaacgtatttcaaggacgcagcgtattagccgaaaaagacttcacagcagccgaactcgaatatttgatcgattttggtctccatttgaaggcacttaaaaaggctggcgttccgcaccactatttggaaggtaaaaacattgccttactcttcgaaaagtcatcaactcgtactcgttcagcatttaccactgctgcgattgaccttggtgcccacccagaatacttgggatcaggcgacattcaattaggtaagaaggaatcaacttcagacactgccaaagttcttggcagcatgttcgatggcattgaattccgtggtttcaaacaaagcgatgctgaaattcttgccagagacagtggcgttccagtatggaatggtttgaccgatgaatggcacccaactcaaatgttggctgacttcatgactgtgaaggaaaactttggcaaacttcaaggtttaactttgacatttatgggtgacggccgtaacaacgttgccaactcattgttggtaaccggtgccatcttgggggttaacatccacatcgtttcacctaaagagttattcccaactgacgaaattcaaagcatcgctaagggctttgctgaaaaatctggtgccaaactgttgattaccgacgaccttgatgaaggtatgaagggctcaaacattgtttataccgacgtttgggtatcaatgggcgaaagcaactgggaagaacgcgttaagttgttaacaccatatcaagttaacatggaagccctgaagaagaccggcacacctgacgatcaattaatcttcatgcactgcctgccagcattccacaatactgaaaccgaatacggcaaggatattgaaaagaaatatggcattactgaaatggaagttactgatgaagtgttcaccagcaagtatgctcgtcaatttgaagaagcagaaaacagaatgcactcaatcaaggctatgatggccgcaacacttgggaatttgtttattccacgtgtataggacaaagtaaaatttcagcctagtacccaccttgaaaaatagctcaacaatacaagggactggcaacaaaacatttgttttgtcccagtcccttattattttctaagacggaggagaattattatgggacgtaaaattgtggttgccctcggaggcaacgccatcctatcaaaagatgcttcagctgccgcgcaacaacaagcgttgcgcgataccgctgagcacctggttaaattcattgaaaatggtgaccaactgatcatttctcacggaaatggtcctcaagttggtaacctgttattacaacaagctggtggcagcaccagtgataacccggaaatgccgctcgattcttgtgttgccatgacccaaggcagcattggctattggatgcaaaacgccatggaccaagtgattaaagaaaaaggcttggacaagactgttgcgacagttgttacccaagttgaggtcagtgctgacgatccggcatttgccaacccaaccaagccaattgggccattcatgagcgaagaagatgctgatctcgctaagaaacagaacccggacttcagcttcgtggaagacgccggccgtggctatcggcgggttgttccttcaccaaagccaattggggttgttgagacgaaagcggtcaacgccttggttgatgccggcatcgtgccgatttcagttggtggcggcggtgttcctgttgtcagtgatggtagtcgactggctggtaaggaagcagttatcgataaggatttcgccagtgaaaaacttgccgagttggttggtgctgacgcattgattatcttgaccgcggttccaaatatctttgtcaacttcaacaagcctgatcaaaagaaattggagcatgtatcagtcgctgatttgcatcaatacatcggtgaaaagcaatttgctccgggaagtatgctgcctaaggttcaagcagcgattgactttgttgaagcaactggcaacgaggtggttgtaaccgctttggataacatcgaaggatttattaatgatgggtcggggacaattatttcggcaaaataacacataattccgattttgtccttaaaatcatcttagactttgtttaatgtacaatctggttatttgaggtacacttctaatgagaacacaattatgtaaccgtttttgggagtgtatttatgattttaaagaataagagtgattatgagtattatgctaaaaaactgcgccgccatcctgaatttagtccgctgagtgataagtatatcaatcagttgattgatgagatgactgttaaaacctatcatcgcggtcaaatcttgtttgaccagggagatacccgtgatcggttctattatttgatcgatggggtttgtaaatcttttcactgggacaaagacggcggcgaacagctgtatctgtatattcgacccgaaaaggcattcccatatattggtttgtttgaagacgatcgctatgcatacacggtccagacaatgtccgaggtcaaattagccgagttcccgatgccgatttatgaggaaattttgcgtgagaaccctgagttgatggtcaatgctgtcaaagaaatgagtcaaattatcaacacctctgagactcagcttcaacgcatggtgaccaccagtgcaaaatgccgggtttggaacgcaattctcttcattggtcaacaaattggtgattatcaagaagatgagacaatccttgttccgtatccaattacattggttgaactgtccaaggtgagtggaacaacgagggaaacgaccagccagatggttcagcagttggttgccgagaacaaggttcaatataatcgcaaatatttcaaaattttagagattgacgatgattcatattaattgaatattattcaagggagtgagctaaatgaaagagcatgatggtaaattagggctgctcgaactgatcggattggttgttggatcaatcatcggtggtggtgtgttcaacctgatgcacgacatggccgtaggagccggagccggtgcgatcatcattggttgggttattaccgccattggaatggtgatgttagccttgacgttccagaatttgaccatgaagcgtccagatctggatgccggtgtctatagctacgctgaagctggctttggtaagtacatgggatttaattctgcatggggctactggttgtccgcttggcttggaaacgttggttatgcgacactgttaatgagtgccgttgcctacttcctaccggtatttggggatggccaaaacatctggtcaatcattgcagcatcgtttattttatgggcctgccattttatgattttacgcggggttgaatctgcatcgtttgttaacacaattattaccattgccaaattgattccaatcttcctattcatcattatcgtattgtttgcgtttaagatgaatatgtttaccagtgatttctggtttacaccaagtgggaaatttgaatttggtagtgttatggcacaagccaagagtacgatgttagtaactgtttgggtcttcatcggaatcgaaggggcggtcgtcttctctggccgtgcccggaaacgttctgacgttggtaaggcaacagttcttggaattatcaccgttattttgatttatatgttaatcacattgctatcatttggtgttatgagtcgtgcagggttggcacacttaactcaacctgcgatggccgaactgcttcaaagcctggttggtaaatggggcgccatggttgttaacggcgggttaatcatttccgttgtgggtgcctggctgtcatggaccatgttcgccggtcaattgccatacgaagctgccaaagaaggatccttcccgaagatgtttgccaaggaaaataagaatggggcaccaattacctcattgaccgttaccaacatctgtgtggaaatcttcatgttctcgtacctgattacggcttctgcttataacttcttctattcaattgccagtgccgcaattttgattccttacgcattttcagcattctatcaattgaagtattcattcctggaagatcatggcaaaggacgaaccggcaacatcattgttggaattatttccagtctgtatgcctgctggctgttgtttgccgctggagccaacttccttctcttgatgtcactgctctttgctgccggaattccagtgttctggatcttacagaagaaggataaccacgccgagaaggtctttggaccgattgaaatgttgctggcaatcttcattgtgctggccgcaatctatgcgatttatggattgattgttggacaaattactttctaattgtaattcgtgacggagaatgaatttgaacagccgtatatttgtaactaagggagcagctcaaatgagccgctcccttagttattgattcttttaaaaataagcagtcacaaacaaatacccagccaaaccaaatgcagctaatgaaatcaaaatccgcagcaaatggatatttgagtgacggacaatgatcggtccggtgtagccgccaattagcaagccaaatccaagcgggatcaccaatagccagtcaatttttgacttgaaaataaaaataacggttgcaatcaagttgccaccaaaggcaatcacattcttcatggcgttgaccacggtaaaacgatcatcagtgatgattgataaaattgcgaggaagataacgccgcccgcagcaccaaagtacccagtgtaagctccgactaggacaattccggtcaggctgatcagtgacacccagaagcgcttggttggcgtttggtgtgcctgcttcaatttggcagtggaaacgtccttttttcgaccggacatgaataacagaatgccggcgaagaggatgaagaaaggaaccactttttcaaacgacgaagccggtgcaatcagcaacagcacactaccaccgatgcttccgataagtgaaagtatgacgtacagggtcaattttttccaatgccctcggagttcctttagcgaagaagccgtcgcaccgattcctgagaagatcagggcagtggtattggtaacattggcaataactggcggaagccccaccgctaacaaggctggataggagacaagtgaagccagcccggcgactgaggcgagcaatcccgctgcgaagccggcaatgattaggaaaataaatgtaagcaccatgagttgggctgacctcttttcaattttttgatacttctaatatactacattttacaaagtagtcgaattcatcttgtgaggggcttgatttctgatgcccaacccttgataatatttaactatcaacacaagatgaaagcaggttacccatgacacaattattttttgactttgacgggacgatcgccgactcggaagccggcattctcaaatcgctgaagtacgcagtcgacaaaatgaaattgccggaactgacacatgatcaatacttgaaatttattggcccggcactcaagaccagcctccaaaaattttatccccagctatctgaagcggatcagatgcaggcgttaaaatactatgccgattattaccgtagcgaggggatgttccaactcgatctgtatcccggcattgtccaggagttgcaggccttgaacgaacagggctacgacgtcaatatcgcctctgccaagccggaagatttgattcatgaattgacggatcaactagatttgacgcaatactttaccggtcgatttggtgcggggactgacgagaaaacccggatgaccaagacagcggttctcaaatatgccttggaacaaactcatgccaacgccaacgacagcatcatgatcggcgaccgtgacaccgatatgcttggcggctatcacaatcaggttaagacgctgggagttacttatggatttggcgacgttgccgaactgttgggcgcccatgcgaatacgttggtggataagcccgagcagattcagggcggggtagagaaattaatcagctaaagacgccaagagcgtgggccaataagcggttagctttcagagtataaggggattacccgaatatccagaacttggatatttgggtaattcccttatacggccggaagctgcttattggcccacagttctgctagataatatttaggcgcaaaacgaggctggaacaaaattttaagacggcattttatctaattttgctgccatgaacgttttcgtatcaagcaacaagataagtttttgtagtttcaacctttagttatttaaaatatctgctctgaaaatcagcaattttatggtattccggttccaaaatttcactaatttgtgcccataatttcatcaaatcttgataacattcggcattttggggattcgcttgccatttttgctgatcagttgatgccaactcatttaaggctagtttggggacaatttccaaactgtgaagccccataatggccgcacctaaagctgaacccgccgatttttttgaaactgtcactgtttgattaaaacaatccgctaagatttgtacccagaacgcagattgagaaaatccaccagttgctttcacattggcaatcggacctgctacccgttcaatcatttgcgtgacttcacacaaatttaaaacgatcccttccaatacagcccgaatcatgtctgcttgggtgtgttggcgcgtcagtccaacgaaactaccacgtgcatccgcattccaaattggcgcccgttcaccacctaaatagggcaaaaaaattaagccatgggccccaggaactgattttgcagctaacttaatcaactcaacgtaagatgactgcctatcttttgtgaaccactgctcctgtacccactggagaacaatcccaccattatttacgggaccacccacaagccactgatcttttccaaggacataacaaaataattttccagccggatcaaaaaccggatggtcaacgactaatcggactgcgccactggttccaatgctaactgctaattgaccagagttagttgcaccaaccccaaggtttgcgagtgccccgtcactactgccgataataaagggtacatcagtatcaagatttagctgagcagccattgttgcagacattccagaaaattgggtttctgtgctcaccaatttgggcaattgatttgtagtgataccagcaattgccaacgcctgggcatcccaggccatcgtttgaatattaaacattccagtagccgaagcaagtccttcatctatcacgtaagctccaaaaagtttaaagaaaatatagtctttaataccaataaacttggcagttttggcaaataactgcggccgttcttcacgaaaccacataattttggtcagtggggtcatgggatggtttggcgttcccgttttaaaatacaaggcttgagcaagaccattttcgcgaagttcagcactttgtttttcagaacggttatcagcccacgtgatgacttgggttaaaggtttgtcttggccatcgatcaaaatcaagctgtgcatggctgctgaaaaggacactcctaaaactttccaggacttttgtttagctatttgcatcacctttttaataccagtgacaaccgccgcaaaaatctgttctggattttcttgtgcgtaacttggttggtcttgatgaagtgggtaaccattattctgattggctaaaacggtcccttttagatcaaacaaaacaacttttgtacttgttgtgccaatatcgacaccgattattgcttgcatggtgttctcctaattatattaattgcaaatccgatcaaaagtggttaaactaattgctaacattcgtgcctcatttgctttataattttaattgtaatcgaaatagaaatttataacagaaaaatcgttgtaaatattgagaaaggatcataaaaaatatgaaaattggtatcattggcgcaaccggtaagtccggctcaaaaatcgtgactgaagcactgaatcgtggtcatcaggtcacggcacttgttcgtaacaaagataaggcaacaaaattatttggtggcacagtaaccattattgcaaaagatgcttttgacatcactaaacaagatttaactaatttagacgttgtcattgatgccttttccgttccattaggtaaacatcttgcttatcaacatattgatctggcagtccatttagtgcatttattacgagaaacggaaacgccacgccttgtttttattcttggagcaggtagtttacaaactgatgatggtctcttactggatcaacttaaaaagattcctgactcacaagcttggattgatacaccggaatcacaaactcatgagttagatttcttaagaactgtgacaaacgtcaattgggttggtgtttctccagcggccagttttctcgatggccctaagacagactatgctttaggaaaagatcatgttctttacgatgccaatcaaaaatctgaagtttcaaccggaacaatggccgttgctattttagacgaattagaaaaccctagtgttcatcaagcgcgcttcacgatccgcaacaagtaggcttctacattaaacaacttaaaggagaattttaatgcaaccaaaatctgtttatctcgccggcccattctttagtgatggtcaaaacaatcgggtaaagaccgttaaaaatcttttaaacaagaaccaaaccatcaattctgacgcaatttttcttccaggaaaagatgaatatacggacgctgccgccgggtcatttgaatggcaaattgccacttttaatgcggatattcgtcaaattgatcaagccgatgttgttgtggcgatccttgattacgaccttgaaaatggccagcatgaagccgatgccggaaccatttgggaatgtggttacgcctatgcccagcacaaacccgttttcttagttcgttttgataaacaaacagaaaattcaatcaatttaatgctggcaggtagttatacagccatgttcaatggtgaaaaagatattgccaacttagctacttatgatttttacaatttgaaaaataaatacgtccatctagacgtcatttaaaaacagtttcttttaaacccataaaaaagaatcccagcaacgacagggattctttttgtttctcaattttttaaaaaatcagtcattaattgcaaagcttgtggtcgcgcggctcccttgaattgatgtgagccaccaacaacaatatgcaattcactattttcgtacacttcttgataacgttctgatgcttttttatccaccacagtatccgcatctccatgaattaaacaaactggacccttatactgtttggcaacttcataaataggcattgtctgtgccgttcgcagataaaagccacccactatctgtcccttttgggttggtaaagcatctggaatatgattcggttggtacgtgacaccctgcaggtcacctttaagcgcatcgtcctttaatgtcgctgcaggagccaacagaaccagctttgaaatatactccggataattaccagcaagcatactcgccacaacaccgccttgagagtgtccaatcaaaaaaatgtttccaatatggggtaatttcctggtaaacgttaaaattgcgttgccatccgaaatttcatttaaaatcgtcatatcttgaaaacggccgtcacttttgccatgcccattaaaatcaaaacggattgtggcaatcccatcttcatgtaatctttgtactacttgtgctaacagatctgtctttcgataacctaaatcaccagtaaagccatgcatcagaattgcaatatcatacttatctgtgcctggtgtttccaataagccgcgtaagattaaaccatctcgtttaatttcaacgtccataaaaagactttccttctataataaaatcagacctttattcaaggtcatcttagcaggattggcaatttttttcagcttattaccctcgaaatgaacagtttatttactatataattcctggacctttttttgaatgtcgacatgctccataaactcgtcatagatagtctcagaacgatcaacaacacctttgtccgatacttcaatgatgtgatctgcaattgtttgaataaactgccggtcatgagaagttaaaatcaatgaaccgccaaaattaatcaagccatcatttaatgacgtaatagattccaagtctaaatgattcgtgggatcatccaataataaaacattggccttactcaacatcattttagaaagcatgcaacgcaccttttcaccaccagataatttggtaactggcttattaacgtcctcaccggaaaataacattttccctaagaagccccgtaagaaagtattgtcactttcctctttaggtgcaaactggcgcaaccactctaggatatctaagttttcatttgagaagtaactattaatatctcttgggatataacttcgagtggtcgtttgtccccaagtaaccgttccttcatctggctccagttcacccgcaacaatttgcagtaaagtggtggttgccaaatcattttgactcaataaagctgctttttcacctggtttgacagtgaaggtgatgttatccagaatcttcacaccatcaattgatttggaaagcttatcaacgcgcaataaatcatttcccaattcacgttctggtgtgaaactaatgaatggatattttcgagttgatggttgaatgtcatccaaagtgattttttcaagctgtttctttcgagaagttgcttgtttagacttcgaggcattcgcgctgaaacgagccacgaattcttgcagttctttcatcttttcttcttttttggcatttgcattttctttaagtttggcagctaattgactggattccatccaaaaatcataattacctacgtaaagctgaattttaccgaaatctacgtcacacatcatggtacaaacggcatttagaaaatggcggtcatgagataccacgataactgtgttccggaaatcacccaaaaaatcttccaaccatgaaattgattgggcatcaagcccattggttggttcatctaagaccaaaatatcaggatcaccaaacaaagcttgtcccaacaatactttaactttttggctttcagttagttcgctcattttttgagcttgcattgtttcatcaataccgagttgttgtaaaagttgtgccgcgtcagactctgcattccagccgtccatttcggcaaactcaccttcgagttcggctgctttaatcccatcagcatcggtaaagtcctctttggcatacaaagcatccttttccttcataatggcatacaactttttatgacccataatcacagtatccaaaactttttcagtttcaaacgcataatgatcctgattcaaacttgacatccgttcattaggtgaaattgaaatatgaccctttgttggttggagtttgccttcaagtatttttaagaaggttgatttgccggctccattggcaccaataatgccgtagcaatttccaggcgtaaactttaaattgacatcttcatagagtttgcgatcagaaaattgcatactcatatcggtaactgttatcatttaatatcctcactattcttgataaatccccttaaatcgagtttcagatctaatccacaattcttaaaatgtatcacaatttactaagcaaacgcaagccattcgggccaaataacgcctaaaataagataactttttaatgataatctctttatgttatttgaattcgttttctttccgcaattgctttttcatgctattctttaggtaattaaattcgaaagcaagtgaggttacatcatgcaacgttcagaacacgactgtataaaactagttccgctgtttaaacacttaccagatggcgatgttgataaaatcgaatccattatcatgcacaaacattacgaggctggcgaatctctatttctcgatggcgacaaactgaacacactcatgattgtcgctaatggccaggtcaaagtttcaaaaattgccgccaatggtcgtgaacagcttctgtatttgttacaatctggtgattttgatggtgaaggggccctttttcaagaaatgacacgcagttcttcgggtgttgcgttgatcccgacgcaagtttgtcagattagccgtaacaattttcaaaagttactcagccaatcaccaagtatcagcatgaatctgattaacgaatttggtcaacggatttcatcccttgaaaaacgcacgaccgaagcttcgacagaaagtgttgaagctcgtattggcaattatctggttgaaaccggggcaagtttggaaaaagatacctttaagttacccatcaaaaaaaaggatcttgcgatttatctcggcaccacgccagaaaccgttagtcggaaactaacagagttcgaacgaaagggctggattacacaaggtcctcaaaaacggattaaattgattgataaggatgcgctggtcttgttggattaaaggttactattcctttgtagccgaaatgtgttaaagagagcaacttcctccgcttagctacgatagtcaaacgattccaagtgcgaatcatttaactatctaggctaatgctcagaagctaccgctctcttgaacactctattcttcctccagcccatcgccagcattattgccgactaacgcctgaagcacacgaatcgcatgattatcatccccacgcaatttttccatataattacgcaatgcgggacgctcttctttttccgctaacttaatggcacgatccacaaacaaattttgcgtcacataatcctgaaccgcctcactcaccatctcatcagccgtaaaatacttgttcttaccattttcaccaatcatcgaatactcactgtattccgcggttgttgaagatggtttttcattttcatctaaaagtagttccccaacttcatcatagtgggttcggttttctcgaatcaaatgcttcaacacatgttgaattgctggtgcgctcaatccctttacgtaccaagtcacctgatgtaatttcgcatcaagcaccgtgaaattggaaacaatatgattcaccattgcccctgctgtgggcacatgatgatcgatttcggattgtttctgttctgctgcaaataattcttctggagtttttgacatttttggttccccctaatttcttaatatgcttatattctatcgagtaactgctgacgttaaattgattaggatcaagttttaaaaaatttctagttcttaactacttattctttcgacccgtttttcttatgctataatcatggcagcgattacaacaactgtaatcatatttagcataggagaaatttttttatgaaattaggtgcaattgaagctggtggaaccaaatttgtatgtgctgttagcgatgaaaatattactattgaagatcggacacaatttccaaccacaacccctgaagaaacaatggcgcaggtgtttacatattttgagcaacatcccgtggacgcaattggaatcggttcgtttggccctgtttctttaaatgaagaagccgataattatggttttattaccaatacgcccaaactagcttggaaaaactatgactttttaggtgccatgaaggctcattttgatattccattttatttcactacagacgtcaacgtggcggcttacggtgaatacaaggctggcgcaggtcggggcaaacaaaacattttgtactggactgtcggaaccggcgtgggtgccagttatcttcaaaatggtggatttctacaaggctacagccaccctgaaatgggtcacatcttgttgagacacgatcctcgtgatcatggttttgaaggcgtttgtccttatcatggtgattgttttgaaggtttagctgccggaccatccattgaaaaacggtttggtaaaaaaggaaatgaaattgatccgagtgacgaattctgggaaattgaagctaactatattgcacaagcttgcgtcaatgccactttgatcttacgcccagatatcattatctttggcggcggagttatgaaacaaagccagctcttccctcaaattcaaaaagaatttgtcaaacaactagcagactatgtagatttccctgaaatttcaaattacattgtccatgttgaattgggcgatgacgccggaattactggtgcattgatgttggctaaaaaggccactgaataaaattaaaaccaagtttagttggatagcgagtcatccttaacggactttccgtaattgatggccgctatttttagttggtcaaaaaccactctgcttcccctctctgcgtaagtaagctaaaatacacttaacaaaacaaaattaggagtgattaatttggcaaaatacgaaacattattacctcgatttttaaaatatgtaaaagtaaacacacgctctaacccagattcaaaaacagttcccactgatcctaaggaagtagccttcttaaaaacacttgctcaagagcttaccaatcttggtttacaagacgtgcatacccaagcacaaagtggctatgtcgtagctactttacctgctaatgatggcggcaatactcctgtatttggttacattgcccacattgataccgccgacttcaacgcggaaaacattgatcctcaaattcatgagaattacgatggtgaatctgatattcaattaagtaaagatggcaaatgggtgcttaaaacttctgcattccctgcgttacacaattacaagggtcaaaccttaatcacaacagatggcacaactttgcttggttctgacgataaatctggtgcagctgaaatcatgacagcaatggaatattacattaaccatcctgaagtaaaacacggtgaaattcgcgtcggctttgcccctgatgaagagacaggaaccggtgctgatcattttgatgcaaaagactttaacaccaaatatgcttacactgttgatggcggtccgctgggtgaattggaatatgaaacattcaatgctgcacagacaactgtcgaaattcaaggtaatgaagtgcatacggcaacggccaaaggtgtcatggttaatgcccttcaagtgggaattgattatcataacctcgttccagctggtgatcgtcctgaattaactgatggccgtcaaggatttttccacttatttaagatggaaggcactcctgatcatgctaaactagtttatattattcgagatcatgaccgcaaagtatttgaacaacggaaacaagaactacaaaacattgcagataaactaaacgcagactttggtgaagaacgcgtaactgttgaaacccatgaccagtattacaacatgcgcgaaattctcgaaaaagatatgacacccgttgaaatcgcaaaaactgccatggaaaatttggatattacccctgtaatttatcccgttcgtggcggtacagatggttcaaaaatttcatttatgggtattcctacacccaacttattcgcaggtggcgaaaatatgcacagtcgttatgaatttgtttcggctcaaaccatggaaaaagcagttgatttgattttagaaatcaacaagctaaatagtgaacaaagtaactaatttttcatatagaaactaaaaacgttattcggttacctgttttaaaaacagatggtgaataacgttttttttgataactttttttcatttacatcaattgtgctagaaaaaaattcatcagttcaacaaaataaagatccgaaaagggatagattttcctttcagatccttattttgcataaacaggttagttttgtttttttagcatcaagttattgactcataacggcgtaattaataactttcaaacttgaatatgttaaaacgactattgaggtactctacctaataatttctttggtgttgtcaaataaattgagaactatgaggattacaaatagtaatatagctatcataaaaacggaatgaaaaccgttaagcagaactgaattaattgcgttttgcaatgaatgaccattcctaaagggagtatttgaactgatagcgttatttaatttactaattgttagcgacttattcgctttaactccctggtttaaagcgaagttaaagactaatccgaaaatacctgtcatgacggtttgtcccaatgttcgcccaagtgtgagcattgaggatgcagtcccaatatttccctttggcacaagttcttgtgctacaacggtattcatggtaatgataataccaagaccggcaccagttataccggcaataacataaaacatcattattgggaaatttgttcctgcaaaaactaaaggtacgtaaaatgccgtttgaattacaactataggcaatactatatacttcggagcaaatcgttttaagaggccacctacaaaaaatgaagttatcaaccataaaacaggactgggtgtaatagccagaccagctattgaagccgatacatggtaaattgactgtaaccacatcggaaaatacacttgaaacccaatctgcacaccagaaagcagtaaggctgttgttatctgaattgaaaaggttcgattactaaataattttaatgggattaatggatcttctgtacgtcgttcgaccattatgaagaataccagagctgcagcaaaagtaataaacggtatcaaccagaacatgaacgaggtactttgcttgctaagattttgtaagccaaggagaagtccaattaaacttgccgagagtaaaactatccctggataatcaatcttaatctttttcgcattaaatgaggattcatggtaaccaaatacgattaatcctaaaacaaggataccaagaggcacattaataaaaaatacccaatgccaattaagtttgtccactataaatccaccaataagtggcccagcaagtgctgaaataccccatgctgtattatttcattgccataatgttggaacgtctttcaaaactaaaaacgtcagcgatgattgtaaatgttattggcattattgcacccgcgccgataccctgaattgcgcgcgaaacaattagaacaataatgttaggcgaaaatccacaggcaattgaaccaatcagaaaagttaccaagccaaaaataaatattggctttcttcccagttggtctgccaattttccatagatgggagttgtaacagcggtagtaagcaagtacattgcaaatacccaactttcttgagtaataccatgtagttcactcacaatagttggtaacgccgtagtgatgattgtcgtctccactgaactcatgaacgttgcaataaaaattgcagccagagtaagagttatattactttttttacttttttccaaatgtatacctccattatttttttgcattttcgcgtagctaaatatttatttcagcaacaaaagatggaagtgcacgatttctattatatagctaatcattaatttcttgcaaaaatttgtttagtgaatccttaaaaaatgagcttttttcattcacttttttaggatgattattaatatcaataagtgaaccataagcattgttcccgctgctttccgctgagctctaggaccgctcggtaagccaaaaagagacccagaaatatgactcccgcgggattgcgatcccgcctacgtcaccatccgcgcctgctattttccactgagctctaggaccgctcggcaaaacaaaaggcagaatataagcacgatggagacgggattgcgatcccgtctccatcgtgcttatattctgccttttaccgttttgcctcgcgcactttcactttatgccacgtggccctccaccgtctcaatatcaaccttgccatcacgctccacaatggctgcaattgccgccgttattcccttcacatcatctgtcaaactcaatgaaggcgtatttggcctgcttgtcacctgctccggtaaaaacggaatatgcataaatccagccttcaattcctgaaactccttatcaatcatatactgtacctggtacataatatgattacatacatacgttccagccgttgtcgacacactacttggcaaacctgccaccctaatcgccctagccatcgccttcaccggcaattgcgtaaaatacgcattttgaccatcttcatgaaccggcgttcctagtggctgatagcccgcattatccttaatccgtccatcatcaaaattaattgctacccgttctggcgtcaatccaaaacgaccgccagcttggccaatactcaaaacataatctggtttttcctttaaaatagccgcatgcgtcacatctgcacacttgccaaaaattgtggggatttcaattttcacaatctgcgcacctttaatttcatctggcaaacgtttcacagcttcaatcgccggattaattttgtcgtcaccaaacggatcgaacccagtcacaagaattttcatttttatatcctccttaaatttaaaatgctaacacatacatcaataaaatctgaataattaacataggaattgcaattggtgcctgctgtttaatgacacccagcggatccttcatttccattaacgccaccggcaacgtattgaagtttgcagccattggcgtcatcaacgtcccacaataaccagacgtcattccgagtgccgccacaaccactgctgatccaccttgcgcaaccacgaatggaatcccaattccagccgtgataactgcgaatgccgcaaacgcattacccataataatcgtaaacacagccattgccacacaatacaggacaacgcccagtatatgattgccaaccggaaaaacactggaaatcgcatgtgccgtcacgttacctacgccagaagctgtgaaaaccactcctaatgtagctaataactgcggcaaaactccggccgagccaaccgaacgtaccatgcgttgcgtatcgtcaaaaacggcttttccacttgatttggtcaaaacaaccgccacaattaatgaaagaattgctgcagcgccgattccaacctgtccgccaaacggtgtgaattgggctaccaaaatagcagtcacagccaagataatgcttggcaggaaaatccacccctttaatcgcaaggccgcagattcagctgttttaacattaatttctttgatatggcccaccttgacctgttttaaaagagacagtaagccgatcaccaataaaaatgcgcccactaatgcattaggaagccattgacctagggcaaaaataactgcaaacaaagtccaaaacaatccagttccataacgagtcgaattcgttttgtctcgaaacgattcgattgcagcaattaaaaaaccaactccaattaacatgtataggaacgttaaaatattattgattaaactagtcatggtcaacacgtcccttctttgtaaactggcgatcaaataagcgattatatacaaatactaggactaatgtaatcatggcaactggaatggaatataaaacaattcccgtcggatcgactttataccctaaagatttcatggtgctcgccatcaataacacaccaccagatgcaacaaacaagttttgcgcaaagaaatttccaaagttttctgtagccgccgatcgtgctttaattcgatcgacatcttttggtgtgagttttgcttcaacactcgctgctgcttgcgccattggattaatcaaaggccggataaactggacctgcccttgtaaggtaattccaaaaacacaggctaattctctaattaataaatagatatcaaaaattcgcccgggggttaagttttgtagacgatgaatcaaatttacggcagatgcctttaagccattgcgttcgataacgccaatcattggcaaagttaaaaaaaataaggacaccatccgattgtctaaaaatccttgccctaaaatcgctaaaaattttgtaaaatcgattccggatgctaatgcggtggccagtgccgaaatcaaaacgacggccacagtgtctaatttgaatgcaaatcccagtataataactaatacaccaattaaacgtatgtattccattcgcttgtcctccatttcatttattgaatgattctaattttgttatcataaatttagcatgaaaacccattcagagcaaatcagataatcaaaaaaacaagctgcccttaagcaacttgcctcacaaaatcattcagttctacgaccaatccgattcgctaacagatgattcgctgtttgcgcggatgcgttgaacgatataaattccgataccaatcacaaatccaatgatggcaggggttagccacgcaaacccttgggagaagaatggcacatatttactttcaaaactagttaagctttccacaaaagctgatttggcaataaacgcaggagctgcatttaatccatcgacaattgctgggacgatggtaaaaatcgttgtgcaaatgtaaaccactctcgcacgatggaatagtggggatgccagcgaaagcaaaatcaatgtgatacatagtggatagataaacattaggaaaggtaccgccgcattaataatagtttcaaagccaaagttagaaactacaaatgaaattgctgaaacgataatcacatatgttttatacccgaatttaggaaacatactactgaaggcagtcgcaaacgaggtggttaccccaacagccgtagtcatacacgtgatggttgccatgattgccaagatgtaaacaccggcatttccaaagaagtactgggtaatttgaccaagagcaatcccaccgtcattcgcaattttcaaatggccaagacttgttgccccaatgtaagctaatccggcataaattaaggccatcgcacttgcagcaatgattcccgctttgacagttaaattagccactgttgattcttttttcacacccaaagccttaattgccgtgatcacaacaattccaaattcaacagatgccaaggcatccatcgtttgatagccttgaataattccgttggtcatggaaccattacgccaagcaccggtgacagcttgccctgctgtcgtgcccataggtttgaaaattgcaacggcaatcaagataacaaccataataatgaaagccgggtttaaataacggccaacatagtccacaactttatgccgattaattgaaaaaaggacaactccggtgaagaaaaaagcggagtagatgaaaagccagattggtgcggtagcagcactcacatgcgtggcaattccaaattcaaacggcactgtggctgttcgtggcgtggcgaatgctggaccgatggcaatatacaaaatgaccgtgaagattaaagcgtacgttttaccaattggttgagccagttcgtatacaccgtgggttctggtaattgcaattgcggcaacacctagtaaaggtaaaattgtgcctgtaatgataaaaccaataattgaactgataaatgctgaaccagattgttgaccaatttgcactggaaatgttaagttgcttgcaccaaagtacattccaaaaagcattgaagccaccacaattaattctttccatgtaaatttacgtgtttgttccatttataaaaccttcctttctgtttctgcattttcttatttaaatcaaaattctatgagaaataaaaaacgtccctcggattaattaatccaaaggacgtttacacgtgttaccaccttaatttacaagcttttcacaaaacttatcttgccatgtacgccgtatttttcatcaaaaacacttgatacattggcactatattgggtgcaaccataatcatcttagcgacgattccactcattttcatctttttaaactaggaaatatgttttttcagcgccaaacactttctaaaaattcgctagcctatactccgtgaaaacttccacacgtgtttctcatttatatttaatgtttttcattataggactgctgaaagtgattgtcaaatgtaaatttgcatctttaaaaaaacaaatatatcttctttgtttcgttccaacgttggcgcaagttatgatccgattggcaagatattcaataaacccctgatttgtgcaatatatttttcaattttactaatgctaatatctcaatagcgcaaacttatataaattgggaactaattattgtaaatgataagtcaactgataaatcagcggacatagtggataaagaactaaaaaaggattcaagaattaagctatataatcaagaaaaaaatcagggtgctgctatggccagaaataaggcaattgaaatggctgcaggggattttttggcatttctagatagtgatgatatatggaaaaccacaaaattaatgaaacagatacaatttatgagtttgaacgatatctctttttcttgtacttactatgggaaaatagatgtgttaggaaatgatgttaatcaactagttacagcacctgaaattatgaattacaatggaattttacttcattctcctggtaattcaactgtaatgtacgacgtaaagaagataggcaagatatatattccaaatataaaaaagagaaatgattacttaatgtggttaaaagtaataaaaaaagcaaaaatgattttatgtttgaaagaagaactatcgtttcatcgtttaagagaaaactcattatcatttaataaaactacacttttaaaatatcattggaagatttatcgggattatgaaaagttatcatatattcgatcaatatatatactttctttttttattatgaacggcgttaggactaaaattatattgaaattcaagaagagagatttaaatttttacaaaaatagagctcgttaatttgatgaaattcagcttaggacaggagtgtaaaagcatgcgaattctacaattggtatcgtactacaatgataaattctaccataatatgatgaaagaaatgatagatgggggagttgatttacgggtatgttttccaagagaaagaaactcagatatttctgtaaatatggaaaattttgtggatacattcgaagtatttaatcgtagagaccgatttttatttactataaaggaaaaaaaagtcctagataaagttatttcgctttatagaaataataagcccactatagtacacgcacatacattattttccgatggatatattgcatataaactaaataaaatgtttggtattccatatattgttgccgtacgtgctgcggatgttaatgtttttctgaaataccgcataaatttgagacaaattgggcgaaatattttgaacaatgctacgagcgttatatttatttcagaaaattatagaaataaagtattaaataactatgttaaaggggcagataggctagctcttagtaaaaagagtgtcgtaattccgaatggaattgatatgttttttttgaataatccgtataaaagaaataaagagccaatcaaaactgctaaattattaacggtaggttttatctatccccggaaaaatcaacttacagtagctaaatcaataaacacagagaatataaaaaactatacaataattggaaaagtattaagaaaaagttatgcagatagagttcttagtattcctaatgttatacacaaaaattttatgaataaatcggacctgattaaagagtatcgtaatgcagatatctttgttatgccatcgatttacgaaacatttggactaacgtatatagaggctatgacacaaggtttacctgtaatctatagtaaagggcaaggtattgacggtttctttaatgatggagaaattggcttctctgtaaatccaagaagtagtacagatatacaagagaaaattggtttgatcataaaggactatgataaaatatctaaaaattgtattcaacaagccaataatttttcttggaaaaatgtaatcgacaaatataagttgatatataagcagatagatgaaaacaggtgaagctagctttgaagaaagacgttattattagtttctggttacagattgcagttatcgttggatttaacttggcctattattttgtaattgcaaaggaatatggctacatgggattttctgctgaatttaaatcagataaatttatcacagtaacaatcctttcgctaatattgctcattttaggaacatcaataaaagatgctttttttaaattaatatggacaattttttttaatattttctttgttggtgaatctattcattatcaatatagcttaattggtaaaccgcaaattatggttagtgtagctttcttcttgattcttttatggttagtttctaagtttagatttccagatgctaaacctatattaaaaaaagatttttttgtttttctagcgatattggctgttattatgtttattccgatagctattaagtatcatagtaatttaaatttgagaaatttattattacaagatgtatatgatacaagagctagctataaagcaagctccggtggaattatagggtatattagtgaaccgttggttagagtgttattgccatatttaattgtagtgtctatgcaaaagaaaaagaaattatatatattgttattttcttttatgattctgtttgtttatttaattggagcacttaagagtattttatttgggttgattgttttattcttcttttattttggaagctatgcagtgaaggaaaaaagattattagaagtacttagtggtcttagttgggttggattggtcgtatacaagttttttcaaactccagtaattttagatttacttgttagacgagttttttttcttccggcatatattaatcaagtcagtgtagcttatttttctaatcacccaacttatatgtctcaatcgccttttggactgggaattgttccatatacgtactcagaacccttatctaattggattggcgattatctgttagggaggataggtatgaatgctaatacaggtttatttgatgaaggatatatttcttttgggatgatgggagcattagctgctgccattattgtgcttgtgattattgtttattttaaaatgataagttttaatccactttttctgggaatgttgtttgcttacatatactatattaatacttcattcctatctattttactcttaacacatggattattattttttatggtattttcatttttcttcttgagagggaaccaatctaaggatggtagctaatagtgaataaattacttactttagtaaagaataagcaaagaatattaggggatatattactcaatgtaatttctagtttaattttagttggattgatacaaataattatatttccattacttgctagaaaagaaggatcagcaaattttggcgaaattgctgcaatttacggaataaataatgttatttccattgcgcttggtaatacactaaataatattcgcttattgaacactaaaaaaaaaggatttcaattaatcgcattaataattagtatattttcattcttaatatctttttttctatatttgttttatgggaaaacacaaggtattaatactattttactaatgtcactttttacagggctaattaattacagaacgtatgcgtgcgttaaatatcgacttgatttacagtatgtaaaacaattaataatgaacttatacgttagtttaggttatgtagttggattggctatttatttcaatttaaataattggcctataatatttttagcgggggaactatttggatatgcatatctaatgaaatcaactaatatatttagtgaacgaattgttattggtaatgatttttggttgattatcaaagaatttaaaaatttgagtttagctaatactgtttcttcaactttaacatatctcgatcgatttttaattttaccattacttggatcaagatatatgacaacttttttttcaaccagtattgcctctaaaatatttaatttagtcatttcaccagtaacgaatgttgtcttatcatatctaactagatcatctaagaaaataagtaaactaaggttgctgcaggttaatttaatattattagttttatttgtaccgttattagcagttttaaaagttttaacatcggtacttgtaaaactgttatatcctagtgtgtatttagatgcaaaaccacttattttattaattagtatcggggtgcttgctaacttaatgtttagtattattaatcctatttttttaagatttttcactatgagaattcaattaatattacaattttcttttggaatatgttatttatttttagctgttattcttgcaaaaaaatttggactttatggtttttgtttagcttttgctattgcatatattatgaaatggggtttacaaattttcattggttgttttgcaaaatataagtaaaggaatttaagaatggagaaaattaatatatactttcaaacggtaacacgtggtttttttcagcatttatttagagctgatatttcgaatattagtttttctgggaaaaagcagtacgaagtggctaataggtttcacaagctactttctattattgtacgtagtaaatttgctgatgttttaggtgttattcaagtagttaatgccaaaaatataaataatatatctatcaatggtagtttcaatagatttttaaatacagaattaccatattttatttatttagagaatccgacggctttatatcattattcaatttataggaaatccacatttctaggtaaacaggcgttaaaaaaaaatctgcaaagttataatttgaataaaattatttgtatgtcaaaagcgtgccaaattggtatgaatagaattttacgtgaattaaatgtttctgtagatactgaggttgtttatcctttagttccagataataagtacattgatgtaaataaaattattaaaagatctagtagtttccattttaatgttttatttgctacacaaggtatccggtttatatcgaaagggggtcttgaagtcgtcaaagttgctgaaaaattaagtggtacgaacataatttttacaattttaactgagtcaaaatatataccagagagtgttaaaactaggattgataagttagataatattcaattaattgaatttgggtatacatttgaacaaatgcaacagttgtatgcaaagcaaaatcttcttttacatctaacaagtgatgatagctttgggttggttatattagaggctttaaaatcagggattcctgttatttcaaccaatctgtatgcaattcctgagatggtgaaaactggatataatggttatctatatagacctaaatggtacttttttgataaggataataagcccaaccccaaagtttggaatcatagaaagaagacgttatataatatagatataatagataatgatattgtagatttctcagttgatcatattcttgaattatacaaagatcgtgaacttcttttgcagatgtcgttaaatgcatttaatacagctaatgaacaaccattctcattctcctatattaaacatcaatgggagttatctatgaaacaaatatacgaggagaaataattatgaaaataacagtagcaggtacagggtatgtaggtttatcattggcggttttactatctcaacataatgaggtaatagcgcttgatgtagtgccagaaaaagtagaattaatcaataataaaaggtcgccaattattgatgattacattaccaaatacttggcagaaaaagaattagatttaacagcaacgcttgattataaggccgctctaaaaggtgcagactacgttatcatctcgacaccaactaactatgactcagaaaagaactattttgatacatctagtgttgatgatatcttagaaaaagttactgaaatagatccaagtgcggtagttattattaaatcaaccattccagttggatttacagaagaagcacgtacacgctttaacaacaataatattatttttgcacctgagtttttgcgtgaaggtaaggctctttatgataatctgtatccatcacgtattattgtaggagaagactctaaacgtgggcatgtatttgctggattgttacaagaagctgctattaaagatgatatttcaactttatttgtatctagttcagaagctgagtcaattaagctattctctaatacttatttagcgatgcgtgttgcgttctttaatgaattagacacttatgctgaagttcgtggattagatactaaacaaattattgatggcgtcgggttggatccgcgaattggtgatcattataataatccttcatttggttatggcggttactgtctgcctaaagataccaaacaattattggctaattataatgatgtaccgaataacttaattcaagctgttgttgatgctaattcgacacgtaaggattttattgctaatcaagtgatcgcacacaatcctaaaaaggttggtatttacaggttaacaatgaagtccaattctgataatttccgacaatcagcgattcaaggaattatgaaacggatcaaggctaaaggtattgaagtcattgtttatgaaccgactttaaaagatattacgttctataattcagcagtagttaacgatttagatacttttaagcgtgaagctgacgttattgtagctaatcgtaacgctgatgagttagcaaatgtacaaggaaaagtttatactcgagatttgtataatatagaataattgagcttgaatcatcaacgtagagaattaatttctttttagataaaaaaggtaaaccaacttctcaaaattgagaaatcggtttgccttttatgttataccactattttgcaagcagtaaacaaaagccgtcaatgaagcccaccaaatccttggtattctgtaagcagtaaataactgaccggcttcaaaaataatttaattcaagttatgattggctcatcaaataattggtgaggtgattttttatgaaaagaattaaaaaatgagtataccaaacaaaagggtagccaaaatacaaaaaattttgtacactcaggttgttatcagatttaattattagttgagatcagagcctgttgtgagcgctctgattttttaagttcctgataagtttggccagtatcaatcatggcataaacaatccgcagtaatttatgggctagggcaacgaccgctttttgccgccccatatgtgaacttaagcgataaaagaagtcctttaatccagtattcttttggcgctttgcgcccatcgctgcctggaccatggccgttttcaagtacacattaccatgcgtgatgtgactgcttttcgatttaccagctgattcatagttacctggacaaacaccagcccaagaagcgagatgatgcgcagtaggaaacggacttacatctgcaccaacttctgcgacgataattttagcaataccctcactgatgcctggaattgtttgtaggcgaagatacagcgctttgaacggttcgagctgtacttcaatttgttgttccagttcagtgagtgcggctgttatctgctttaataattccaagagaatatcaagcagtcgtcgatcgttagcggacagaacgccatcaagcgccgcttgaatttgttcaggcgttgccttcatccgaccgtgcatacacttcttgatcgttggtaaagttattttttcaccattaactaataaatcaagcaatttacgacctgcacctttaaaaatatcagagatataggtcgtcaatttaatattagatcgttgtaagaggttatgaataacattcttctttttagtgatatcttgcgtaagcgatttcttaagtcgggttgattcacgtaattcttgaatcgcctgtgggggaatgaaactagccgatactaagcctaatcgacctaattcagcgatccattcggaatctttttgatcagttttcttaccgggaatatttttgataattcgcggattacatagaatcattttgaaaccaaatggcgcaagtatctgccagacaggtcgccaatactgaccggtactttccattaagactaattcaatttgttggtcacataaccattggccacattctttgagggcaacggtagttgtcccaaagcgctgggagtggcgctttggtttagccgctgcagcgccaattaaagtagtcaccgtaatctgtttttgatggacatcgatgccacaagcagcttcagttatcacatccatgatctgacctccgttcaagttattaaaggcgttactcaaatctttgatccctagcggataggaaattttttattcgtgttcaagacgacaataggttaatctcatggattaaagaccatcggtttttatttcaggctcaaggcaccaataaacagacgatgtacaaaagaacgccttcaccgctagtataacggtaaaggcgttcttttcatagatggttacgcgcggcgaccgcgcggagagtttttattggataaaccgggtattgttcaaattaaaatggatcatcctgatgctcaatcacgatcgactacggcttacaaatcagaattgatactaatagatcggtggtggtttacaaccggattaacaattatattttggaggcagttttaaaggtggtgttcgctggtgataattgatcaacgacaaattcaacaagtctttttagtttgtggaaaaattgatttgcgcaggggaatcgatggttagctggcgttatccaggatcaatttgatttggatccatacaatcgcgccttatatttattctgcggtgatgacggccaagcagtcgtccatcttctgccaagttttcgtccagtgtgccatcaaatcgtccaacaaagatagacgatcggtcaacatctatcatccaacctcctgtatactttttagcctgttttacatttaccttgagtgcgtatctgttccagtgtaagcacccaataacagaccgactataaatagcgtatcggccgcggtatgatagcctcatcataagaaatggtgaggtgtttttatgctcaataaaccggaaatcgttcaagttaagctggacgacggtcaacgacagccaagtccaatagcaaaggcctttcaaatcaaacgtaatgaacacgaaacaatcattgtttacaatcatatcaatggatatattttagacgccctagtcaaggcggtgttcactgatgctcattgatttacaccaactcaagggtatttatttgatttgtggcaaaactgacctgcggcgtggaatcgatggtttagccgctacgatcactgatcagtatgaacttgacccctacagccgggcgttatttcttttttgcggtacccgtaaagatcgttttaaggccctatattgggccggtgatggctttctcttactttataaacgaatcgaaaatggccgcctgcaatggccaaccaatcaaaatgaggtgaagcgactacacgccaaacaattacaacgtttattatctggctgggggcttgaagcaaccgtgcatcagaccaaccgaccaaaaaaagctaggcttagctgactaatcatggtacactcaggacaatcctagtgaatgaaggcgattccatggcaacgaccgtcgaacaacttaagcaagcccaagcgcagaatcgtgagttactcaaagaaataaaggccttgaccgcaactgtccaaactttgacggaagaagtcgccttttttcagcgccaactttttggcaagcattcggaaaaaataactgatcctaaccagttatccctattggcagatgacaatggggtttttaccgacccagagcaaactgggaaccaaagcgaaacgacagtaacaacagtcgtccataagccaaagcgtaagcgttgcgaatcagttgatcccaatctaccgatcgagaccaccgtgatccgccgcgagaacttgagttgcgatcatggtcatcaactgataccagtgggcaagcactttgtgcgtgaagtcgtgcatcaaattcctggtcgcctctatcgcgaacagatctttgaacaaacgtataaatgtgccgcttgtgaaacgaatgatggtgtttcccacttatatcaggggactgcgccgcaggcgctgatcccccatagtttagcgacctcatcgttagtcgctgagttgttgtaccaaaaatatgccttagggacaccactttatcgtcaaatgaaagcctggcggcgggctggtttgattttaagtgaaacgaccatgacgaattgtgtgatcaaagcagcgacgatcgttcaaccgctgtatacattactgcacgaacaattattaacggcgatgaaacaccgtttcaagtcttgcatgaggtgggtaaaaccgcgcaaagcaagtcttatatctggattgctcggagtattcgcttagctgcgcatcaagttgtctattatacgtatagcgacaatcgtgccggcaaaactgcccaacaactttatggtgattttatgggtgtcctacaatgtgacggttattctggctataatctactgggcgcaacggtgacgcgggtcggttgttgggcgcatgtgcggcgaaaattcttcgatgatgcctgcaagatcaaggggcaaccgacgataacgccacccttaaaattgcttgatcaaatgttttacctagaacggggctggcgtgatctaacaccaaccaagcgcaaagaactacgccaggaacaattaaagccagtgatcaagcaattttggcagtggtgtgatcaagcggtggctacctcgaaatcacgtttaggtcgtgctttgacctatgcccaaaaccaacggtctgcacttgatcgtgtgctcgattacggcgaaattgatctaagcaataacgccactgaacgaaatgtgaagtctttcgtgattgggcgcaagaattggcttttcgccaccagtcctgcaggggcacaggctaacgcgatttggatgaccttgattgaaaccgcgaaagctaatggtttggatccccggcagtatctcgaatacctgcttgatcaattagggcaactacccgtttttccaactgaggaagaactggtagcttgtttgccatggcgacaagtgccggacaaaaaggtttggcgtgatcaacaagcgtagcccattggctaatttaaaactaaacagcgctactgattcgaaccaaaaagtttcggatcagtagcgcttcttttgattacggtcgtttattgggtgcttactatacttatactaagtaactataataattgcgttaaacgaataattttgaaaggtatcctatcaatgaaatttaccttaccaccgatctattagcatcaattctgatctgtagggcctttattgccatagtagatcgtgattgagaatcgggatgatccattttgatttgaacaatatctggtttattcaataaaaatcacctcaccaattatttgctgaggcaatcacaacttggattaaattatttttgaagtcggttagttatttattgcaagggtggtaaataatcatgctactaggagtcatgcttattatttataaactcgatattcagttgtggcctgttctcccgcaaactaaagaaccgctgccaatatttaatcgctagttcctcatcaccgcccaaactactagaaattgcgttttcaacaatattgcagtatacgtcagcgattgactcatattctactagtgtagcttttttaggatacttaaagagtttatgatcaagctggtcgattactgatgacggcattcccatttacccccttcggcataaaattttaccccattaagcgaagaaattgaccaagttctgcaaaagagattgaccagccctaaggtacctcttgtataatatgatagcgcatacattgcgtaattatattatacaggaggttttttatgtccattcagtatcgtaagattcttgagctccatgctcaaaaggtcgtacaacggaatatcgctgcagctacaggtaattctcgccccaaaattgcagagatcatcaaacgggcaaaagaagaagtgttagtaccaccgttcactgatgaaatggatgacgaatggttcgaagcgctacttttcccgcataaaaagcgtgagtctaaaggcagacaattgccagattttgaacatatccatacggaactagctaagtctaatgtgacgttgtcactactacactatgaatatgaggcaatgtgccgtcaaaataatgttattccctacgcttaccgcacattttgtcagtattatcacgaatatgcacaaaagtataaagcgactatgcgcataaagcgtaagccgggagaaactatggaagtagattgggcaggtacaacattgtctctaactgattcagatacaggagaaattgttaaagcttatttatttgtcgccacactaccgtgtagccaatatggctactgtgaggctcgcttgtcaatgaaacaagaagattggttagttagtcatattcacgcttataagtactttggtggggttacggaaatccttgtcccagataatttaaaaactggtgttaccaggcaccaagctggagaagctgtgcttaattcgacttaccgcgaattggcaagtcactataacacgattatattgccggcacgtgtccgaacacctaaagataaagccaacgtcgagggtagtgtaaagatcctttcaacttggattatcgctgcgctacgtaacgaaaagtttttcacattaatagaattaaatcaggctgttagggaaaaattagatgagtttaatttgcgaccattcaccaagaaatataaaaaaggtaaccgtaaagacgcttttattagcgaagagcagttcgcattacagcctctaccacgggtaccttataaaatggcaacctggaaaactgccactgtacaattagattaccacactaatgtggagaatatgttttattctgttccttacgaatatatccagaataaagttgatattaaagttacgaaagatctcgttgagatcttttaccaagatagtcgtattgcctcacacaaacgactttatggcaagcttggtcaattctcgactaatcatgatcatctaccagagaaccaccagttgtatcttgattacaccccaaaagaagcaattaagtgggccgaaagtattggtgaagcaacaacggaagtcgttcgttatttgcttaaatcggcaaaagtggaaaagcaagcactgaaagcaacccttcgtttaaagaattttggccgtaagtactccagtgaagcgattgagcaggcttgccaagatattataaaaattgcctcagcaccaacggtgccagtaatcgagcgtttattacgcagtaaccaacaacaggagcaacctcacaatgcaagtgcacaaaacacttatggcttcacgcgtggcgcagcctattttggaatcgaaggggaaaaagataatgacatcagatgaaactaagcgtaaattacgagaaatgcgactcaacgctatggttgagattttagaagttcaggaacagcaaccagaataccaacaaatggattttgaagataagtttgaattaattgtcgatggtgcttatgccagacagcaatctaataagcttagtcggctattacacagcgctgattttccgagtatagagcctgcgttagccgaaatagattatttgccagatcgcaaattggatcgtaagctaatccaaaaactagcaacagggaactacattcgtgagcatcataatattattttgatgggcgcatctggcaatggtaaaacttggctcgctaatgccttaggcatagaagcatgtcgccaattttataaggtgaagtatgttcggctgccagaacttttagacgacttagctgtagctaagcatgaagctaatggaaattttcataaaatattagctcgctataaaaaagttgatgttttaatcattgacgaatggttgttaacggagttgtctttagagcagtctacctatgttttagagctagtagaaagtcgattacatcaatcatcaaccatttattgttcacagtttgcgccagatggatggcataataaactaggtaatccacaaatagccgatgcaatccttgatcgcattatccatgatgcctacccgattttaattcaaggcgataaatcaatgcgtgaacgctatggattacgaggtgactctgtatgattccagaagatgtgcgcaatcggctcgctagttactactttcttaactcgatagaagaaagctttgaaaataaattggttgatcggttaacaatggccatgcttcaaagcaatgaacaaattagtgagaatgagctcgttgatattggtattaaattgatcaaagaatacctagagcaataacaatgtttgaacccactttagtgggttcttttagtcgtatggtcaattttcttcgcataagttggtcaattctttcgccgagtgtggtcaatttttacgctcacttggttaattcacgatgccgccttcaattacatcagtttgaagattaacggttaaataattcagaaaaccgtaaatagcaatttgagtgtcctcagcgggttctgcctgatctaagtagtcaaatatcatattaagtacatgctgttggctaaactggggcatcttgttatttagccaagtaagcatggtgtaaataaagatgtcaaaatcgaagtccacttcttttctatattctgcaatcagtgggtcatatttagaatcgattttccaagttagattgttatcgttaaagataaattttggtacgtagttatcaaaccaagtatctgagttcattagttataatccccaataatctaagtaagcgctttattgaattgtaacatagaagaaagcatcatcataggccacataatgcaatctaataggccatggtttgcgaagaaataggccccatagtgcgaaagactaaaacaatctagctgatgacggtcaagcagccgtaccttctgccaagttttcgtccggcagtgccagcaaatcgtccaacaaagacagacgatcggccaacattagtatagtcgtcttgatcttttaacgagtgtttaaataattatgtgtaaatgattcattgaaaaagggaagcctctcccttatgatagttgactggtacattttatttaaggcgcgtaatttcttaactatggaccagaatgtactgacatagtgaaaagtgtactggcttccactgaagacttactcgcaatcgcgagaatgtactggggactttgttagttgattcaatgtggccatctaaaaaaattaactgtatcctatattaacttccatctagtttgtatctacattgaaggacccggttaaggtagctcgacagctgagttacagtgagttctttgatggattcttcaatatagttacatgcttctgtagatggacaaatattacacgatttcgtctctgcagtcaagcgtattggttgaacctgagttattgcaggctttaagacgcaacttttcaactgtatcgacaaatcaactcagtaagacggttgcaatagcgtagcaagtccttactgcttgcttattcaataaatctgagagaaacaaaccattgattgctttaaaaaaactccaggaaatgacagaatgtacttgaaatgttttagtagagataaacagactgatcccccagaaatatcgtcgtctatcattcatctgcaaactcccagtgtaaatgtgccagcttcactgtgaagtgattgacaactttcttatcgtaccaatgtgtccatataaaacaaaacgacttaaattcagaggaagaaaatagaaagagagaaaagaaaatattaggaaagatagaattgtaaaaggggtaaagaaaccatatcgttaaacgtaaattatacgtcaaagttttcaaaacggttataatgatgaggttttattatgaatgtgattttgaatattgatatccttctggcaagttttagcagcaatatcagagcacttatcctatataataggagttgggaaagacgtgagtaatatttcaatatcatggattgtgtaaagatcagacccaaagccaacttaaataaaaagttattatacaaatactggaaagtttgatagtgcaagctgataaattcaaactacttaacctgctcgaggatctttgtaaatgcaaatggttatgaaataaatcaagaaatgaaaataccgtcaaggatagaagaagctgcattgcttctagtgggcagtaaccgcatgttccaagggtgtatatctccaaactgatgtcaggaagggtgttttaagactgcatatcctggaaggcgacgccctagatacatagtacatcttatgcttcaaaataccccccaataaggagacgcgtttgtactgttaacagacctcacttacttgtcaacaatatacaaaaacagatcttggcttaacaattagattatcccctttttgaaccattcaaacaaaggctgaaacttaccagaaacaaccaaaactctataaaatttgaaagaattgggccactttcccaattcatacataaagatgtaaaattaggtactgaaagccaatgcattcagaatgttatttcaagtaaggttaagtcagaacgacactagttaaaaaataagaacgagaacagtctcttcgtccacatacgacaaagcgataagatgggttcgagccgtccttcttaggtacatataagcatactatcatttgatttaggtaaaaatgatgacagtgtcgaagtccaacttgcctctgagtagcatccatatcaagtttttctacctattgaagggaaagctacaaaagctccatagagtacttgaaaagacatatagtacatgaagtagaatttgctatttttcaaaatctacatgagaccttcttgctctcatacaataaatcagctctggcctaaaacatcagcactttgttggcttagtcttgttgaacagtaaccgctctggcattacatccgtagctaatgtctttaaggctgtaaataaacaagacagtaacgtccattctcaacagttttctgtccactttataattgaagtaaaaaataaaccctttgaactgcttttcagtgagttttgtcattcaataatagatacttcagttcacatacgtgttacgggatgctcatccaataatggaaccgctaatactcttatccttgaccatatgcgcctcaagctgcgccacttgctcaatgacattttagatcaaggacctaatgttttgcaattgtagatttgcctccttagcttagtggtagagcgttgcacttgtaatgcagaggtcgctagttcaattctggcaggtggcattattttttcctggtcattgtctttttttgagaaggtatcacatatcattgaagttgggttggttccatggagaggtgttaaacattgaggctcctcacatcccacctaatcatcaaacaagtgtaaatgattgcagataccatctacttctattacttcctcatccatataccgattacggttttcatggatgccacatttgcaattccatatgaatggcagcttccaatccaacgccaactgaatgcattccattacaatgagaacaaggattttctagcagtgaactcacctttatggatgcgtattttcgttgtctgggaattgattttccagttaccatttttcatctatgcagtggttgattatttaagaaatggacggaagggttactctgtgagattgtggcctatgttcttcttatatgggttcaacgcgggatttacgacattggtgtgtttgatttacgtttattcagagagtgcaattcatggattgaacatgactgaaatgtggaacctcgtgggactctatacgcctacaatggtactaccattctacatgatgtgggattttggatgccgtatagtaaccagattaactgattttgagctggagactaaagagaaggttttataagttatgttcaatcgttaaacgttcaaaaaactggaaagtatgtaagaggtaagtgagagcttcgcttaagcggagtacttagcaagcaattggtcaacgagagcaatgtacttttgttcagcttcttcttgagaagtacccttgagtttgtcccaagattcccacttgtacttacccttaaaatcaaacattcctggcttggtggtgtcgttgtcaccgacggtagcttgtttgtagaggccgtacaattcgagcagctcgtcgtcggaaggtctatttggtaaattggagactaaatctgcctgcaatattaagatataggtgcgccttctttcatgcgtgtgtgtctatgtgttagtatcaatcgatgatgaacatgtgatgagccttgaaccttgagctttgtgcctatcagaagagatggcttttgttgggagcagagttaaggaaacgaaccttttcagtgaatgttgcggagaccattgtagttgcgtgtctgatgtaattacctgttctgagagtggtcagtatgtctatactttcctttgttttattgtacgagctgtggggatgagcatataggggggcgccgtgcctcgtctttataccgcagacggcagatccagaagagagagtttccccgagcagccacaaagccagcccaacacaagcgcggggtgtgctgcgccacaaaaggaacagcgcgtggcgcagcaacgacgcgtgcatgttttgctgagacagatcacgccaagagttctgaccacgttggtgatgagagaagcatagaacaaagagtcacagcatccacagccattgacatcagtacagcacggcacagaacagcagagcaacggctatcaactttcaccatctaccatggcggaaagcaaccactccaagcgcagtttgctacttgctattgcagtcatattccatctcatttacctatggtccatttttgatatttattttgtctctcccttggttcatggtatggctcaacacagggccaccattgaaccaccggcaaagcgtctttttcttatagttggtgatggccagagggctgataaaaccctgggcaaaatccaccatcctaccacagacgaggacgtgtatttagcaccatttttaagatccatcatccttaatgagggtacatatgggttatcacatacaagaatgcccacagaatcgagaccgggccacgttgctatgattgccggcttctatgaagatgttagtgccgttactaaaggatggaaggagaaccctgttgattttgattccgttttcaaccaatccactcacacttactcttttggatccccagatattttacccatgttcgagcaaggtgccactcctgggagagttgatgcttggatgtatggtcacgaatttgaggatttcacctccagcagtattgaattggacagatacgttttcaaccacgtgtaccagttgtttgacaattccactaaggatgctgaacttaatgcagagatcagacaggatggtaacgtcttcttccttcatttgcttggcaccgacacttctggccacagttacagaccttactctgccgaatactatgataacattcagtacactgattatgagatttccaagcttgtgagtaaagtgaacgaattttttggtgatgaggaaactgccttcatctttaccgcagatcacggcatgagtgattttggatctcacggtgacggtcatccaaacaataccagaactccactcatctgttggggtaagggatgcagaaagcctgtgaagattgacccctctcagaatacggttttgaattctggtgacgagtacgaaatcagtgaaatgtccaaatgggatttagatcaaattgagagacacgatgtaagacaagcagacattgcaccattaatgagttatcttgttggtctcaactatcctatgaacagtgtaggtgagttaccacttgcctttatcgatgattcagagtcccgcaaaataagaggattgtattataattctttaagtttgcttgaacagtactacgtgaaattgcaggaagttaaggagaatcagttcaaatatactaattttgctaaatttgagtcaaagtcaattgaagcatacaaatctgagattgagtctcttattgcgcaagtcgatgttggtgctgacgttgaagcggaaactgttgaactgatcgaggagttcaattctataattttagaaggtctggattatttacagaaatacaactggttgatgatccgtacagtcgtgactttaggcttcattggatggattatatattccttcacacttttcttgcagatgttcattatccctaaggcgaaggttatcatgaacagagatgtcgctaatgagaatactgaaatgaagaaggaaggaaaccataccttcctccaactatttttcatctcacttagtgcaggtatatcatatgttttctattctgagaaacgtccactgaactattacttataccttgcatttccaatatatttctggtatgaaatagtgaaacacaagactgatatttacactggatttaacattttctttagggacttatcgccagcaataagaactctaattttcgttggcattgtcattttctttgagtccattgctattggatttgagaacagagaggttttcagtatcatttacatcacattgtctgttgtttacccagtgctactatttagaggatccattttcactgatgcacgtaaatttgttatctccctttcatggttggcaacttgtttattgttgtcacttttccctattcaaaatccggttaaggttgaatctatcaattccattgtcatttcaggagtcatcatgacttgtattggtattgtgggctttgcaattttgaaggatttcatgtccccaaatacaaagcgcattattgtattccagattttactagtcttactttccatctactccacactcaaggccgtcgtttcactcacgaatcgtgaaggtctaccactagatgcgcaggttattggctgggctgttatgggagtttcgtttattgttcctacaattcttcattgcttgaacgtgaacacaaactacagaatcagattccttatcatcttcctgacgatggcaccaacattcatcattcttgccatttcatttgaagggtacttttacattctctatgcaatgatgatctatgaatggatagagatggaatccattgacaccgcttccaactccaatagtagcatgaaactattacgtatttcgatgattgggtttttcaatttgcaaatcgccttcttcggtactggtaacgtctcctctatttctacattctccctagattccgtttacagactattaccaatttttgatccattcccaatgggtgcattactaatgttgaaattgatcattccatatgcgttattgagcactggattgggtcttgtcaatctcaagtccggatttgctaaatatagtgtaacgacgttgatcatttcactttgcgatcttctctcgttgtggtttttctacatggtgcgtacagagggttcttggttggatattggggtcagtatcagtaattattgcttagccattttcggtgccttgttcattggcattgttgaagtggggagtggattagtgcttcgtggtgtgcatattgatgagagtaagcatgaacaaggaattgataacgtgattgagatggagacgattctctttaaagaggagaatagcgtggatgagataagtaagagaaaggtgtccaagaaactgaagatggatactgtcgaatatagtgagattgaagatatgatggaaacggaagggctgaacgggggaagcatcggtactagactgcaccgtagaacccgtccgatcaacttagattgaagttgatgatgaatgagatttatttatttacataacgaccatatattagaagctagaaacccgaaatcccccctcacttgatgtgatagatatcgctgttctattaagtaatatgcaccacatgtacttatatacatagtttcacaggttatggattacacaatgaggttagagttcagtagcgtttcattttgtgtaagttatgatccattttttcttatcctcgtcagtaatggaccaattttctaattttttccccttcttgagccattcttgcaaagattgcaatgcttgcatttctatctcatcaaggtcgagtttattgaaatctcccagaccccctacaaaattctcattatggcggcccgcattatagtcatcacttgtcaacttcaaccacagactggaacaagaacctccggaattttcaatttctctgtgatctgaagggcacctacatctgcatccggaagcgccaagatcttcctcgcgtaaatgcgacccctttccaattgccggtggatcataatcggcgtagtagatctcatcttctggtaaaacttgatgtttgaatttcggtccagccttgtacggtagttgatgtggtgaattgtaaggacagtgacctattgttgaatgtttgtagccaatgtctctgaaatagtggatttcatcaagtgagagaaacattccagcggctagggagtgaacgggagcgtcaccccaacgttcagtgaagaatccatttgattcctccaagaattcatagtaagccttatattgagggcttgtgaacaatttatttgaagcgatttcgaaatttgaccaaaagtggcacatattatagtttcggttattgtatttctcctgtactggagagttgagaccttgcattttactatgtttcaccaaaagctttagaatttttgggtcgttcgttgtaggtgcattcaacttggcgtaatagtaaagggtattcttgtgcaatttattccaaaggtcattgacatttttcacatcaaaatagaggttttcattggtaccggtgtagaatttgaagttattagtgaagaatttccaagtgtcgggcagttctatattttgctccttaatgaatttttctgtatatctgaagagattgggcacagtatcgacgagttccttaatggcgatagtgtatccatattttttcccacgtttctccatttcgataaatggatcgtaagtgagatcacaataaaaatcaacttcaggttctacgcgccaataccaatcgagttccacaactagtggatgttcaaagaaatatcctgagtagaatctgcacatattgtgatacgatggcatattaccatacatgattcctctatcaccttggctttccactgcttcattgaaatatagttggtcagaagtggattgtgattgttgttgatcgaatttccatttattctgaggaatgacaccgaatttgacgtcaccactagctacttcataaactctagtttcaaattcttcagtaaagggttcatcattaatgaatatccatgggtaattaaaccactgattgaatcttcgttccaaacttcgcatactcaaaatgacgccatctatctctgtattacgtgcaagtacgacaaatgcggcattagcacgaggtttctttgattccaccaatggatcacgacatccgtattggaatacatcatcaatgacggatttgaaagaacgttcactgatgggacatttggttagtaatgaatcagagaatttatcatcataagatttgataattttagagctggcaggagtatttcccactccattagcatctgttgatatgagatcataattgacaatcagtggttgagttctgttatttgtataaactaatccttgtaataggagagagagaactaagatgaaggataacagcttccagagctttattttgcgtaatgagataggtttgatgtttatgttgatgttcacatcataagaagcaaaacgattcagcacgcgccttattcggtgtgggagagacgtggaatgcgaggcgggtctccaagtcatggacgcagatatacaagtggtagtgcgtgtggcgtaattggttctgtggccgttgtcgttacctttcaacgcgcagctaattaaaatgaggcagtccttagctcttagtccttagggcataatcatgctactcgaggctggagactggagacatgaaaaatgaaggaatttgaaatcggaaacgttcactaaggaatagcgcgaaaaacgaaaaacgaaaaacgaaaaatgaaaaatgaaaaacgcggctcgtcaacagtcacttgtcactagtgtcaccgccgctttggacgttacacattggaagaggaatggaacatggagaaagagagaatacacgcaactagataagatagaactggagtaaggaccacagtgatgaagagaatgcctagaatagactgcaggaagtttaagctgcgcacattggcgatgcaagagggcaccagagtggttgccaacaacaacacgtctagcactagcactagcactggtgatcgtgatcgtgaaggtctcgtacatgctttacatactgtgaataatcggaatgtcaagttcagggaatacggtgccagtatggagcgtttagcggtgtttcaaagagcaagtggtaagaatagagataagcaggaggaggaggaggaggaggaggaggaggaggaggaggaggaggaggaggaggaaggcgtgcaaaggtttcagagatgggtgcatcgcgtgcgaacagagggactacgcgatagccactatggaaggaaggtaaaggaggaaccgcatgttattcatgaagaagaacaagagaacaggaagagacccgttgttggtacagtgccgcagatgattgccatgttagaggagattgcatttcttcgagcgaagaatgcttccaacgcatacagtgacatatcaaagagctgtatacttggcaacgaccatgggtatgtcgttattgacagcaagcaatacagacgcacgctcagtgagcgggcggagcgtttagccaaacgatgccagagcgtgaatgtgaatcgtgatgagttgttggcagtgtacgagggggagctctctgcggagcatgcacgggtgctagccacaaccacaaccacaaccacaaccacaggaacatcattggcgtctgatgctgctggtgccgctgctgatgccatacgagagcttctacgaggcgatcttgtgagtgcggacggtgtccttgtgcgtgctttgtgtgagacacttgcgcgtggatcctcatcccagtgggaagtggcttgggctgatctcgccgtagcactgttgcgagcggtactgggtgttcctagtggaactagtagtattgctgtgtccactccggtatctactaagttgcccactaaggtagtactgccagggagagaggccctgtcgaggcaatgctgcgcctctgtggcgcgggcgctgggacagcagggccatggggcgcaggcggcggcggtggcgcagctggggcgggcgtaggtggcgcagcggttcggaaggcggggtgcagatatccggactcgagaattggaaaattgaattgtcggcgccgagccgcgccttcccttatagtggcagtgtggggggagagccggaatccgcttgcagctggccaatgggcgcgctggccattgcaattcgcaccaggctggcagcgggcgacagcgctgcacagcacagcacagtatagagcgtacaacttgaactactcaattagtaacagtaacaacggcaaaggacacaacacaacacaacaggtctctgtctatcgtctactcccagccacatcacacatcacacatcacagcacaatgaagtccgttctcaacttcgcaagatctatggcaactaccgccgcaaaggttccaaacatgaagaccttcaaaatttacagatggaacccggatactcctgatgtgaaaccacacatgcaatcttatgacttggatatgaatgagacaggtccaatggtgcttgatgcacttctcaagattaagaatgaagttgacccaacactcactcttagacgttcttgtagagaaggtatctgtggttcatgtgcaatgaatattggtggtagaaatacccttgcatgtctatgtaaattagacaaagattcaggtaaagaattgaaaatttatcctttacctcacatgtacattgtcagagatttggtgccggacttgactctattctatcaacaatataagtcaattcaaccatatttgcaatcagataaaccaatgccagagagagaaaatttacaatccgttgaagatagagctaagctcgatggtctctatgaatgtattctctgtgcatgttgttccacttcttgtccttcatactggtggaatcaacaagaatatcttggtcctgcagttctaatgcaagcatatagatggatggtcgatactagagataccgcaactaacatgagaaagcaaatgttgcaaaactcaatgtccttgtacagatgtcacaccattatgaactgttctaagacttgtcctaagggactcaacccaggtggtgccattgcagagattaagaagtccatggcactttcctgagcctcatcgtcgcattaattcaaagcaaccaaactctctcgccttcgacaacgctatcgatccaaccacttattctttataaacctcatataggtacggtagacagtagcgccaagtagctgttcattccaaccgttcctcgttctccctttatatcttttgtttacgactcaaactacaccattctctctgctctctgtctctcttttctcttcagttcgcgaccatcactatcaaatctggagccttcactctccaccctccacgaatcaacaatcatcaacaacacttcagttctcataaccctacgctaataactaccactagcctatcgccacatcaccatgtctaacacttacacacaggcgcgcacacaggcgctatcattatcgacacaattatccaacgcgctcgccacgtacgcctcattcgcaacaaatgatggtatgtcgtcaacgtcgacatcaacatcagcttccaatgaaaccacctccgttgccatctccaatagtaagaacaagatcgaatctttacttagcgagttatcatcatccatctctgcattacaacgactagttgatgcaaatggtactccatccaaacaacaacaactcgctcgtcacagagatgaattacgtcgacacagaacagattttcaaagactttcctcacagattgaatctcaacgacaacgtgccaatctaatgcaagacgttcgtgaagatatagctgcagcaaatgcttctgcaaataatgaagaagattatatgatggatgaacgtcgtcgcgttgaacaatctcatagtgtcgttgatggtctcatatctcaagtattatctacaagggatgaaatgttcagacaacgtggtgtattagataatgcagctggttcattagaacgtagtcttagtaccgttccgggaataaatacgctattggcgaaaattgatgcaagacatcgtagacaagccatcattctcactatagttgtgactttctgtatggtggtactttggttctctctataagtaaagataacacgtatgtaacatttgaatgcacttaataaactgcaccattgcactcagcaacacccagcatagagcatagtccgacggaagatggatgtatgcgcgcgtttgagcttctacgttctaagttgaagattgaataacatcaaattccaaatccttcatcattatcatcagacttcataataaacccgactacaggctcgtgacacaagcaaacgaaacgaaacggacacgctcaatggaagtttttgcccaagagtttacaacgtttgtcgcctcgcttgaaggcaaaacgccctctccacgctgcgttattgacgatacaagattaagagctatcgcagcagagatacatgacacactgaccaaacacgcagacaatgcaaatgaatatgctgcatatctcaattttgcagtgggacggtactctctaacactacatgaagagtacatggccacatatatcgaagcggtccagaacgtggttgatatggatgatgatgatggtgatgatgatgtcgacgtagtgaagttggatcctgcattcgtcgactctcacgtccaacgtctgttcacactcttggatttgagtattgtcctggatactgaatatgaaggttgtgaatcttttgcaatgcataccttcgtcacgctgctttcatacacgtatccaatagatgtcataataacccattttgcacccattttcttcaaagagacaaacaacaacagtaatgatgagaatgatcatgtccatgaccatgatgatggtgctagtgctgcttataggaggatattgttgactaagaactatacactacagggtaaggtgaagcccggatctaggttacttgtcttatataagcaaatggtggaaagaattccactctatgatcctgcaaacgagaaggttgttgccagtttcagaaacttcatctctgaatgtttccccattgacgataagttatctcaatctttagattggcacagttctaacatcagtactagtgggtaccttgcaagtttttcagagtatgctaaagtgaagaaaattagagatgatgatgtgagtaggaataaaaagaggaatttgtttgtcgattacctcaagttgacgcagtacttgacgacggtgaatgctggagaactcgtacaatcaatgaacaaactgacaccggctatgggatatggacgcggtaacggcaacggtgggaatagaggtagaaataactctagctcagaatctactatactacttcttgaagcgataaacacgaacatgaagaattcccaatcctcactcgagaaggtgcagttacacgataaaactgcaaatatattcaaatgggtgctagatgaacaaactttcaataagcagatacagacatacgacatgtactgggctctgaaactgcaaattctcattattttgaacttcctcaaacaaatgagatttgataactggactacactttgtgattccgttgctagcgaatacggtaaatttcgtaaaccagactcattggttaaccccatcacatccgtggagggtaagaggcgattaaactcatggattgaggatatagagaaagaatttagcagtaaatttgctaaaaacataagtgtaccgctcaatcgtgaaaatactagtcaattttttcaatttcagataaaaactagtacgatcgatcggcctgtagaacttccggacaatggttcactaatagattgcctcgggaactgccatcataggcgattccctcaaattcacgcttggggccaaactgggtccactcaaagctgccgttagttaaatgaccgtggccgtccagccgtttcgctgggaaactggcaatcgacgcatcggacagcatcaacaggcgctttctaaccgggttataacccatactttgaatccgggtccccggtaaatgtttcagcacttgatgggtcaatcgaaagtgcaccgatttgtggtgaattttacccttgaaaatgtaggcgccccagcctgggaatgaccagaagtaggcgttaccggagcgatcaaaggttagatcgtggccgccgggcaccgatgttccgtggctgtgcagacgaaagcggatcgcgaagtccggccgcaatgtcgaagccttgatgtgttggatatagccccaattattgattggaacccgaggcgccttttcgacatcccgccacatatataagccgtggttcttccagttagatgccaaggattgaccatgaccagtggtaaatatcggccctgccttaatatacttgtgaattttctgttgggtcttggagtatttgccatgccgcttgtgataagcatcccgcagttcttttggatgcaaccgaatgcccatcgcatccagcttcttgatgttaaatcgaacaattcgacccttgttatgtagatcagtcgggcagtagacaatgtacatatcccccttgccattcatcgcaatcgattgtggatttccccaatgctggccgttcttaccaggcagcggcaaaatgtaccgcgtatgaaagctgaccttcttgccgcgttcggatttgattgtgtgctcaacatcagtgttggcaacgtggtaatacttctttggcactttgacataatgaacctttttgttattcagattgcgcagcgatcccttgtgcagggcggacgagcgctggtgataaatatgaaacttggcttgtgcagtgcttggggcggcaaagaaaatcatcgtcaacgccaaaaaaagcccacagcaagccagggtcctagtcaacttcatgcaattccccctcagaaatgaatgaatattaagatttcgtaaaattagttcacaacctatattagccttccgtttaacaaaagtaaatggctttcatgcttcatttgtaatgataacggggatcgctcacattcttcggaatgaattctggattttttgtcaaaatctcgcaaaaatgcggaaagacaaactgctagttgcttctcattagcagcaatccgcttataatgattggcaaaaagaatctttcccaataatggaggcaaacaatgaagaaacgacgtttggccttactgagcggcttattcctgctaattggcttgctcagcgcctgcaccacatcagccacaggcacacccaaaattcagggtgccaatcaggcaaccccgaccctatttttccacggcttcggcagcagttaccacgctgaaacgcacatggctaacacagcggtcaaagccggcgtcaccaagtcggtcattcgcgcagacgtttcaaatagcgggaaagtcacctttgtcgggactttcaagccggacgacttccacccgatcgttgaagtgaactatttgaattcacgaaaccccaactatcatacccaggggaaatgggcgaaaaatgtggtcgtcaagctgcaacaacgctacggcattaagaagatgaacatggtcggccattctgtcggcaacatggcgatcgtcttttatttactggacaacgctggcaacaccaagctgcccaagctcgagaagcaagtcgacatcgcggggcatttcaacggcatcctgggaatggacgatgcccccaaccggatgaaattgaaggcagatggcgagccgactaaaattaacagccattaccgtgagttgctgggattgcgccacgacaagcaattgaaaacacttgaaattctcaatatttatggcgataaaaacgacggcacccactcggacggcgacgtcagcaatgcctcctcgaaatccttgagatatctggtgccgcaagtcaaatcctaccaggaaaagcgaatcgtcggcccacaggcgcagcacagcaagctccacgataatccgcaggttgataagctgttggtcaagtttttgtggggacgtgcgtcataaccgggtgaactgctgaacatccatttgaaactgaggttggtactggaacaccaaaaactgccacaaaagcaaaaacctttgtggcagtttgagtgtggacattatttagacactggcatccatcattccgaagctgccagggaatccaacatatcaatatgtttgagtttgtaatgggtaatcacgccgactgctaagctgaagcaggccgttaagaccgctgaccagatgtaccctggataatgaacggtcagcgggaacaaaatcgctccggtctgagccttgatcataataaaatgatggaggattaacccgatgccccagccaaagacgatcccggccagggtcagcacaacattttctctggcaacgtaggctgtgacctcattatcgtagaagcccaacaccttgatcgtcgacaattcacgcatccgctcggagatgttgacattggtcaggttgtataacaccaccagacctaatgcggccgacaaagcgataaagatcagcacgactgagcttaaaccaacggttcccagcgagctgctggcgtatcttggataagtcacattcataacgccgctttgtttcagcaggttccgtgaggtcttctgtcgttggctggcactctcactcttgagcttcaacaggtgtgaagtcggtgaataggtcgtcgttgaaacttgattgaaatacttgggggtcatgtagagataatggcccgcgtaattcttggtaaccccggcaaccttgactttcagcagcttattgcccagcttggctgaaagcaggctgccttttttggcgtgcatatcagtagccaatttttcggtgatgatgacaccctgattagttaatttttcagactgaccggtttgagtgctggtcagtgagacataatcgttcaatttcgtcggtgtcttgggggccaccatggtgaccgtcgcatttcgcttggtgcctttggttggtgagacggtaatcgattgaaccatcgccgcagtctgtgctttaatgtttggatcatgcacccgtttatcggcatcggatagcgtgacaatcccctggtagtgctgaacttgattgaactgatcgggaatcagatcgttgacgctgtcccgaatgccaaatccagccagcatcaggccagtacaaccggcaatcccaacgatagtcatgatcatccgggtcttatatctgaacagattccgataactgaccttttggttgaaattcatccggttccacagcggtttgattcgctcgagcaaaatccgtttaccggctttcggagctcgttcacgcatcagctcggtcggcttttcacgtaaattaatgattagaacaactgccgcgctgccaagggtggcgatcaacccggccacgagcgcttcgacgataaatgcccagggaatcacgccgacgtagtgagtcaggttgttattgctgagcatgctgaaaataaatttgggcagggtcaaggttcccaaaacgccgccggcaattgatcccagaattcccgcaagaattgaataaatgacgtatttcatggaaatgaagcccttggtgtagcccagcgcccgcatgagaccgatttctcggcggttcttttcaatcattcttgaaatggtcgtaaaggtgatcaaaacggcaatgaataagaagaagccgggaaaaatgacggcgatggctgcgatacttttggactcatcaaaataatcctgatagccgacgttggcggttcggtcgttgtacaggtaagtcgcttggggcgccttctgtaattgctgcttggcacgggtcagttgtttgactccggcagcgactttggcagtggctgctttggtggttgctgtttgataggcacttggcacagccgacagcttccggcgctatttctgaagttggccaagttgctggtcaaccttctttagctgcgggtcgatcatctctgagcgccgttgagctggccgttgcttgagtttgctttccagccgggctttatcgtgatccacctgctggttgtacttgctggtcccagccgttaaatgagccgtgttgttaaagcgcacggcaatggccgcgtacgctttctggttaaaggccgcggccggcgcataggcaaaataattcacctggccgctgccaacgttggtggtgccacggtcggttgaactgacaaataacggtgagttgacgaatccgaccactttaaaagttttagtggtgagcccatcggttgccggcaaacggtaacggtcgccgatcttgtagtccttagctttttggtccaagacaatctgatcggctttctggggtaaatgcccagataccaatttgagttgatttaattttgccgatttggcataggaatacacctggaccacttgattcggcgatttcttcaccgtcaccatatggctgggttcggcaatctgaaccttggggtcggtgcgtatcaagctgagatctcggttgtttaatcccaaggttgacgtcaccctcatgtcaccgagattctgatgagcgaaatactgatccgcagaattgtccaaatccggaccagtcgcccgaatcccgacatacagcagtgatcccaacaaaatgattaggacgatcgaaataaacttcccccacgcataagtaatctctcgaatggtggctttgaaataggtcgtattcaactttccaccttcttacaagacatttttttgattgagggccgtataaatagcctcttccatggactccggcttggtaattggcgcatatcgatgaatcagggtgccgtctttgccaaccaggaatttagtgtagttccatttaatcttgccatgaccggactcttctttgagatgggtaaacagtggatcctcaccatccccattaacggcaacccgtcgagtcatcgggaaggtgacaccataatgaatccggcaataatcatcggcctcttgatcacttcccaactcttggtggaattgattggaaggcagtcctaacacgaccaagccctcattcttatatttcttatataattcttccaggccctccaactgaggtgccagaccacatttgctggcagtattcacaatcacaacgactttatttttgaattcgctcaagtcaatcgtcttaccgctcatttcggtttctttgtaatcataaattgtcttcattgattgtcacccgttttctgtatttatgattagtgtaaactaaaatgtccgaaaacaaaactggttttggatttgatcactaaatcgccccaatacttcacaaactatatagatatcctcgctcaatttatcgtatatacatagtaggacaggctgatcagacaatttcaataaactgggaggtgaactaaataaaaccaaagtacacatatccacaaatgatcaaacacatgaaggacaagggaattagattcgaattagtatcagagcctgacgcaatccaaatgctggcgactaaaaattattatttcaagttgacatcctatcgaaagaattttcatcagattgatggtaaatatgaaaatttagattttgcatatttaaccgacttggcgtcgatcgatatgcaacttcggcgatacttacttggaatctcattggacattgaacatggaattaaaactcggataattgatcttataaccaaggatccagaagaagatggctattcagtggtgaaggacttcagtacatttaatcagcgaggttatgatcaaactatgaaatacttaaagcgaaatgattacttgcacgatatgtatgtaaagcaccgaaatcacccctccatctggatgtttttggaagtcgcaacatttggtgtcctttccaggtttgtagacttttactatcaccgctccagaaacaaagatgttaagcttgcacatatattgttgaagtatgcaaagcatattcgaaatgcatcagcacataataatgccattatggttaatctgttttccgctgaagaaaaagtaaaacatcgaaatacaacggttgtcatgtttgcaacgaagatgggaattgatgcatctttagtaaccgatatgaaagtaaatgacctcgttagcttgtattccttacatagacgattttcaagtgtagggtcacaggaattaaccagaaaagaagggcaaaaattactgaaaagggctagcaagcatgcaaattattatactcatgagcctgtactaattaagttttatcaactattttccaaactaattaatagttgatgaatgtttgacaagaggctgaaattcttatatattattagcaaggaaaggacggttcgaccgttcgctaaggctttagctcgtctattgcttttgttattggagtcacgaaaaacccgagtcagttttaaaactgaagcggggttttctttttttatgctcacaactgtctagcataaatgagcatgttctcgacatcgtatccttttcaggatatcgttaaaatcggaaagacgggttcaaccacacgctaaagctttgactggtccaatactttcgctattgtattcaagaagcccccgactcagcgtctatgctgggtcgggggcttctttagaaactgcgactcccgggtctggaaccaaaagcacgtttgttagcttcttatgtgctcccttcagcctttaaaatatgctccgacgacccaagcactaacttctaagggcactttgattaaagtcccaaaaccagggacttcaatcaaagtgcccttagaaaccgcgactcccaggtctgaacccaaagcacgtttattagcttattctgtgctcccttcggcctttaaaacacgctccgacgggcttgaccctaacttccaagaggactttgcttaaagccccaaaaccgggggcttcaagcaaagtcctcttggaaaccgggccacccagccctcgtcgcactcttattcaaattgcgcctcatacaactgcttataatacccattttcattcatcaactgatcatgggttccccgctcgacaatcttgccattatccaccaccaaaatctgatcggcgttatggatggtcgacaatctatgggcgatcaccagtgatgtccgctgcttctgaccaccggataatcggattcctcgctcaccgacttgggtcttcatttgctcaggcaatcctttaatgaaggcatcaatatcggctaatttggcgacgttccacagttgatcctcagtcgcaccaggcgtcccataacggatattatcggcaatcgtgccgtcaatgatgaagatatcctgtgacacaatcgcgatgttttgccgcagtgacttgagcttgatatgtttgattggaatgccatcgaacaaaatgtcaccgctatcgacatcgtacaatcgatcgagcaaatcggtaatcgttgatttgccggctcccgagtgaccaaccaaggcggtttgtttaccaaacggaatatcgaaggtcacattctgaatcgcggctttgtgcggtgactggggctcatcagatgcgtatgaaaaagtgacatgcttaaattgaactccagacttaatctgtgggaatccaacagcatcgtcctcgtcaacgatcgccggcttcaagcccatgatactgacaattcggccataagaaaccagtgactgctggaattggttcaacaatctggaaaaggcactgattgggctttgcaggataccaacatagctgagataagcgaccaattgcccaacggttaactgatttttaaaaacaaacaatgttcccaagaataagacaatcgcggtccccagatactcaatgaaggtcaccaacggcgaaaagatcgcctgattccgagtagcctcaatgatgttatttttgttcatgttggctaatttgtcgaaacgactggattccagatcttcagtggtgtagctcttaatcaactggatttgagtcagtgtgttctgcaattgattggtcatcaaggcttgagattgacgagccttttgatatgaatttcgaattcgggttctgaaaatgcggaccaccataaaaatcattggaaatgtcaagctgactgccaaagccatttcccagttaacgaagaaaatgaagcctagcaccccaacaaacgtgaacaggctgccaatcagggacagcatgtttggtgaaatcaggttttgcaggttgttaatatcggacgttaatcgcaccatcaaatcacctgttttactggattcaaaaaagtgggtatccaacctgatcaaatattgatacagctgatttcgcaggttggtgatggccccttggctcatgacgcccatgtaataggtagaaacgtaggtaaaaatccctgaaatcgtaacggtcaacagtagcagaccgacgaccacggccagctgtgccgtgctcttatttggaatgacgtggtcaatgatgtactgattgaattgtggcaataaaaagtccatcaatgacagaatggtcaaaacgacaacgttgacaatcaaaatccatggccgtttgagaaccgtaccaaaaacaaatctgaacatccccatcatgctcacaccgttctgttccccgctgtcgtcatgctgatttggtgcttgattcatgtgttcaccccccggtaacttgtcgcattacttatgacgttatattattccacgaatggtcgggtaaggtcaacggattagcttgcaagctgacatatgccggtaacaagtcgttccgacaacgatcaaatcaataaaaaagagccctagctcaaaactagaactccaaaacaaagcagatatctaattaatccgcgtcttctccagcagcaagtccgccaactccgcggcagaaatgtcacccaaattagccttaatatccacttgacccaaagcatcgactaacgcatccttgttgagatcaacgcctttcagtgccttttcaatcacggaaatatcgccgccggtaataaagtcaccatagatcttgatatcggaaatttggttgccgttcaatgaatagttgaagctgaccgtgccgatatcataatgtttggaaacatagtaatcaaagccgggattcttcccgtagttccactcgtcggtatcgtatttccctttcaaacgctcatcaataattgaccaatcgtgatcgttcaaatgataggtttcaatatcgtccaatgacttggcattaaacaatctcagcagcagggccttcttgaagccttcaatatccaacttttgaaattccggcttcaagaatggcttaacgttggttacccggctttcaaccgacttaacgcccttggattccaatttatccttttccggggtcaaaacttcagtggccacatccatatccaaatcaaacatcagggtgccgccggcagcgtaggacttgccaactttgaacatcgtcatcccggagaacttttgatttccgatcaccatatcatttctcccacgcatttcagcatcggtagcgcccatgtcgtgcagggcatcgatgattggttgggcgaagtatttaaaatcaccaaaatgttggtcatcattaatcacaatattttcaaaaataatgttgccgtaatcgtgatacacggcgccaccaccggatgtccggcgaaccaacttaatgcccttttctttcaaatagggcatgttgacttcggcataggcattttggttaaccccgacaatcacagcgggttggttaacgtacataatcaggccgtggcccggcaacttcaaatcatttactaagtagttatccaaagattggttcacaatcggatcatagacaggtttgccatttctagacgtatcaataaagaacatacaagatccttctttcataattgctagttctggaaccgttaccattatgatagaacgaaagttgctgaatgtatatgccattggtaaattattgaattttttgtgaattttgtgtgaaataagtctgaacattcccggtttgccgttgtcttcactagccaaaatgcctatgctgaaattattgtttaccacattcatcattcaccgaagggaattgacgtgcgcaattgaaaaagctcagatccctaacccaaaaagaactggatcaacagctccattctgatgcgatctatttagtgttatttgttttgacaattctctgtttctccatatcttgggcgcaatacactgcttacaaaaatgacgccagtagtctgattcggatccagcagcgtgataaacgcgctggggttgacgttgatcaaatattagccggtggcccaatcacgtttagcaacggggaaaaagccgaagtggtcactagtctccaggatgctggagaaaaggtcaagcaggatctggtcgagatggcccccagaaacagctttgatcatattctgggatcgtcaatgttcattgtctttccaattaccatggtgatctacacaatttcttttgcctatcgggaactcaaaaataatcaggtcagaatcaaggccagcatgaacagcattcaaaatgtcgtcctctccaaactgattagtttgagcatgctcacttttttgagcctgatcttcatttgtctgacctctttcatctttcaattaggctttaacaattttatccacatcccaaataaactggcgttgatcaggtatctcgcggacggccaatcttatttggcacaagccccgttgcagttcttatcggtatttggcttatcattgatcgccgtgatcgtcagctactacctcaccttattgctcaagcgaccttggctggcaggtgttttgatgtttgggtacttttccggcatccctgtattaggatcatttgacttcaaacaaaacgcggtgctgctctattccaaactgtttcatgaaaacagcccctttacaccaattcaaattaacggcgattttacactgatgggatttgttggctgttgtctggtcacgcttttgatcgcaggcgtaattgattacatcgtcacccggaatcattatttgactcggacttcgtaacccgttttgtgactggttagtgttaatctaaaattaaaaggaggtaatccaaatgagtatgcagcagcttcgcgaccgaatgattcaatacctcatagtcacagtgccattggcgggtttgatcgtctctatccttgggatatgctacttcatgtggtggagtggcgatcattctactggggcattgatttacagcttgattccatttgggatgggaatattgatttcgattcccggatggttttggaaacatgaggctcaaaaacacgatcaccgtgaaaaataaatgaccggaacacaactacttgttagttgtgctccggctttttagtgttctgctattattttatttccgctgctaccagcctcgtcgcacgcctattcaaaatccggatcatcgccaccgtgggctttggcggtgaattctttaacagtgatcttgataataccaacgtaggcgatcgtcttatctggaaccgtaaattcactcaactgctgcccagtctcatgcgccaagacaacttgcagggcgtgccttttgactgctggatcatcaaccaattcggcatccccatagcccatcacgctgcgataagcgaagctcggggtgttttgcttgggatctttgggcaccattaattggccgccatcatcaatctcaaagcccatccggccatcttccttaatcaactcacgtttgcggcctaccggtgcgccgtgaatatataacgtcaaatggtcatcatcgtcaaattcgtagccaaaattagtggggaccacatactgataatcagccgtccgaaaaccgctgtgaatcacatgggaatcctgcaaaatttgcttaatttcgtcaatatctgtaacttcccgatcttttctgcgcataccatcagctccctttatttgcttcaagtatagccattttgggcaacgtcgtatatagacatttttgactgtccgtaaatttttaaaccaattcgttgcacgcaatttgtttacaggttacgcttttagtagttcaagatgtaatcgtttccgagcagactatatgggaggcattttttatggcaaattatgattatgacgtcttatacatcggtagtggacatggaacctttgacggtgcgattccgctggccgcccgcggcaagaaagtcggcgtcatcgaatccggcttaattggcggcacctgtcccaatcgtggctgtaacgccaagattacgttggatgcaccagtagctttgacacgtcaaactgagagactccaggggattctcaatggcagtttggcaattaactggaccgccaatgaaaaacataagcaagaagtcatcgaaggcttgccggacatgatcggcggcttgatgaaatccgttaacatcgacattatcaagggccacggcacattccaagatgctcatacggtaatggtcgacggtgaagccaaaaccgctgaaaacatcgtcatctcaaccggccaacatccacatcgtttggacattcccggaacggaattggctcacgatagtgctgacttcatgaacctcactcacctgccagccaacatcacaattatcggtgccggctacatcagtctggaattcgcaacgattgccaacgcggctggtgccaaggtaactgtgattacccacggcgacaaagttttgcggaaattctatcaaccatacgttaagcaaattgttgccgatttgaaatctcgtggcgtcgattttgtcaataatactgaagttgccaacttcgagcaggacgaccataacttcatcgtcaactataagggcggtcaaataaagaccaactggatcttggacgcgactggccggatgcctaatgtggacgacattggactggataaagttggtgttgactatagcgaaaaaggtattaaggtcaacgaccatctccagaccaacgttgataacatctacgcttcaggcgatgtcatcgacaaggatcaaccaaagctcaccccaacggcgatctttgagtcgacctacttgatgcatactttcgctggcgacacgacggatcccatcaattacccggcaattccatcagtcgtctttacctcaccaagaattgctaaagtcggcgtatcagttgaggatgccaaaaaagaaggcttcacaacaaaggagaaccatttaccagacgactggtaccgtcaagtgaccaaggaagaaattggcgataacacactggtttatgacaagcagaaccatttggttggtgccactgaaatcagcgaccaagcagaagatgctattaacgcattattgccagcaattgtgttcaagttcgaaccggcacagctggaacgtttggtcacattgttcccaacgattgcggcggatgcttggggccaaatttagagtgcgacgagacccgggttgaccccggtatgtaaaacaaggattgtattgatgaacgcatttgttcagtatacaattgttattatttttttgccttggattccgttgttcaatcacaatctcaggaacaattgtctagggaatttaaaaataatgggcataattccacgatacaaattagcgtaaaaagaagaatcaatgttaagctacgtcaaagttactatcggacgaagcggatccatattaagttgctttcaaataaccaaggttctggcgatactgtctattatctagcaaaggtaaacggcatcaaggtacagctggaatccaaagttatttggaaatttccgatacggaccaaaataactgatatatactgagctgtaaatgatgtgacattcaaaaatgcaaaatattagttttctgatggatcacccaagcgccacatccagcaccatcatcaacgtaaacccagccataatcccaaagatcgcccagtgagattcttccttagtcctggcgtgggcttccgggatgagctccttgcaggcgacgtagatcatcgcaccggccgcaaacgacagggcgtacggcaatagcgagttgaccgaagcaaccaacagggcgcctaacaccccggcgatcggctcaaccgcaccactggcttgaccatacataaaggctcggaaccgactcatgccgccctgacggagtggaatcgaaaccgctgcgccttctgggaagttctggaggccaatcccaatggcaaccgtcgtggctgccagcagcattgccgcctgttcgccattaccggcagcaccgatagccccaaaggccaccccgactgccagaccttcaggaatgttatgcagggtaattgaaaagaccagtagaatcgcccgcttaaccgtcgctcgggaactaccctcggttcgagcgcgttttaaataaattccgggaatgattttatctgccagatacaaaaagaatccgccggcggcaaaaccaataccaacgaccagccaggggatccggtcctgctgctcagccaagttgatggctggatccaacagcgaccaaaaagatgccgcaatcatcacaccggctgcgaacccatacatcaaggccaaagcgtgactgcggatggttttgaaagcaaataccaatgccgaccccagtgccgtgactgcccacgtgaataatgtggcgaacagtgcctgctgccagggagcaaaattcattaaagtgtccataacgacctcgctttataagtaaagttcagtttctaccataagtataacaagaagctggcagtgaaagccagtctggcggcaggttcacatttctcagattcaaagtgacttttaatgctaaaccatgataagtccgctatacttagggtatgtaaaagcaaatttttgagaaatgggatgattttttgacgaaggttactgcttacatggtccgtcacggacaaacatacttgaacatgtacaacaaggttcaaggttggattgattctccgctgactgaaaagggaattcaagatgctaaaagtgctgggaaacgactctcaaagattaattttgccgcttcctttaccagtgactccggtcgggcaatcgacaccggaaaaattattttgaaagctaatccgcataacatgaatattgttagttaccaatatcccgaattacgagaacaatttcacggttatttcgaaggcaacgatctcaatcaaatgtggcagttcgtcggcgcccaagttcaagagaccaccgagaaagaagtattgaccaactttggcttggagcgggcacgagacttgattcaccgggccgacttgtacaacaatgctgaaaataacgccatgttctgggagcgcctcgaccacggattcgataaaattcgccaaaacacccatgacggcgaggatatcctgatcgtctcccacgggatgacgatccgctcaattgttgaccgttacgcgccgaaactggatctgggtgtcgccaccaagaacggcagtgtcaccaagttgatcatcactgatgatgacattgacgttgagtacttcaacaatcttggcgaggtctagttgtttctcttctattaatatgatatatttgtaagacatgtattggtcaggacgaatcaagccctggccattgtttttgattatgggaaacgtgggctgtcggtgtatttttgaacgcgactgcgcgcaggctattgaacgaggtaaatcaatgattacgattcaaaacatgggattacaattctcaggtagaaaactctatgaagatgttaacttaaaattcacgccgggcaactgttacggtgtgattggcgcgaacggtgccggtaaatcaacttttctaaaactgttgcggggggaattgaccccaagcagcggtgaaatccacattgataagaacgagcggatttccagcttaagccaggaccattatggctttgaagatcagaccgtcatgcagacggtgattcaaggctaccaacatttggctgacgttatggcggaaaaggatgctttgtatgccaaagctgatttttccgacgaagatggcatcaaggccgccaatttggaagccgaattcgctgaaatggacggctggaacgctgaatcagatgcttcacaattgctgcagtcactggaaattcctgaagatctgcaccaacaattgatgagcgagttgactgaaggccaaaaggttaaggtattgctggcccgagccttatttggcgaaccggatatcctgttgctcgatgagccgaccaatggactggatgtctactcaatcgaatggctggagaacttcttggctgactaccccaagattacaatcatcgtgtctcatgaccgtcacttcttgaaccagacttgtacgatgatgtgtgacgttgattttggtgagatcaatatgtatgtcggtaactacgacttttggctgcagtccagtcaattggctgccaagatgcgggctgactcgaacgccaagaaggaagacaagatcaaggaactgcaagccttcgtggcccggttcagtgccaatgcttccaaatccaagcaggcaacttcgcgaaaaaagcaactagacaagatttccctggaagacatcaagccgtcttcgagaaagtatcctttcatcaagttcgaggagaaccggccgctggggaatgacttgctgagagtcgacaagctctccaagtcaattgacggtgtcaagatccttgataacgtgaccttcactctgcgtccaggtgagaagactgccttggtcagccgtaacgatttggcaacgacgactttgatgcagattttggctggtgaactcacgcctgatagtggtgagatcaaatggggccaaacggttgagatgtctgctctgatgaaggattttgcttcggagttcaaagataacgatcagcggatcattgactggctgcggcaatttgctgaaaagggcagcgatgatgacgcctttctgcgcggattcctggggagaatgttgttctctggggatgatgtgaacaaggaagtcaacgtcctttccggaggcgaaaaagttcgctgcgtgctatcgaagatgatgctccaaaaaggcaacaccttgctgatggacgatccaaccaatcacttggatttggaatcaatcacggctttgaacgaggccttggtgaacttccccgggtcgatcatctttacatctcatgatcacgagttcattcagacgatcgccaaccacattatcgaagtatcaaacaacggtctgatcgataaggcggatacaacctacgatgagttcattaatcacccagacgttcagaaaaaattaagtgatttatacgattaaaatgccgatttaacgcccactttgagacttctcaaagtgggcgtttttttgtcttttgcggcaagcaagttaatgtcatttctgggatatgttcgttataatgggtttggatatataagataactaatagcaacaataaccaaagtggaatacgaatatgaaagtcaataaatacttgctaatgtcacttctcgtgattagcacagggggaatcctgacgtttgccaacgcagattcgacgatgacttcaaatgatgtggcccatgccgcgaccacgcaagttgctgatgatgcggtaccggacgggacgattgtgacgccgatgaaagtggtgaaggcgcccgatccggctgataagactgacaacccaacgattgatcctaaagaacactcggatattccagtgactaatttttacaaaggaagtgtttttcatcaagcacccgtctacgtttccggaaaattggccaacccaatgggcaccaatgcgaaagtgggctcccagacaatttccgatacacagggaaccatcaactctaatgattatattcaagcacccaatccagatgaaacgatcaactatgcttattacaccggctctaatgcctggatgatcggctgggccaaggacaactcgagattttatctgcataacgtcgatagcgatggaaaattgacgaatacgattgaggttccagggccaacggcgagtgatttcaatcccaactgggcctataatgccggtaatgttcaattttcctggcaaaatggtcatattgagttggatttacagaataatgatctgtatgcgtcaagttccgccaatccgcttaattatttaaataatgtgccggcaaaatttgttgatgccaaaggaaacgaattggcgccaacccagaatatctccggttattcaggaacttttgtggatgttaattaccccaccattcctggctatcgacttgtgagagttccctatatgaataacgcccatcaatttttaatcaataacattacggccacgacaccaggtgattggcaatttgagcaatctaatcggtacgtgacgattgccagaaaagtaatcgacgaccaaaatacccaacagatgtacatgatatttgattactcgaagattcccgattttagttttactggcaaagctcaaagtaagactgtgactgttaaggcgacgccgggtggctttatcgctgctgatttcagttatggcatgattcggacctatgcgacggcatcgatgccattacccgtcggtaacccactaacgtttgtctacgaacccatcactgaataccacctcactatcaactcactatcaactacctcgaaaagggcactaacaaagtgctggctgatccatacaaggccagtggtgcgggaacctacgaaattgattctccggaaatagctggctacacagccgatcagccggtagtcaaaggcgtcttaggcaaagacgataccatcaatgtctactacaccccaaaggacgtaccgccgaccccaaccaacgactcggccacagttgacgtgaactacatcaacgaagcaaccggagacttgattcaatccaaaaagatctacggtaaaatcggtggcgactatcaagctgatggcccttatcaaccagataagctgaccgttaacggtgacagctatactttggataaagacaaactgccggcaaatatcaaaggccaattttccgatcaaacaccagcagtgaactactactacaagaaagatgccaccccggtaacgccaaccaataactctgccgcagtgaccgtcaactatatcaacgaagaaaataacgatttgattcaatccaagaaaatctatggcaaaaatggtgacagttaccaagctgatggcccttatcaaccagacaagctgaccgtcaacggcgacagctacactttggataaggctaagctgcctgataatattaacgggaagtttaccgaaaatgcacctgcagtcaactattactacaaaaaggatgccactccggtaaccccaaccgataactcggcgacagtcactgtcaactacatcaatgaagcaaccggcgccctgattcaatccaaaaagatctacggtaaaattaacgattcataccgagccgacggttcctatcaaccacaaacactcaccgttaatgggcagacttacactttggatactgacagactgccgaataatatcactgggacgtacagcgacaagacacctgatgtgaattactactacaagcaaaaacaaaccccagtgactccggtcaatccaccaattaatccggttaacccggtaacaccggtcaacccaacgccgacgccgagtccacaaccgactcccggaacgactactgacaaccaatccggtaagattgctaagaagggcgaagtggtttactccttgaagaagatttatctttacaaagataaaaccttcaagaaggccgatcgtcaatttggttatgtcaagaagccacgggtcttccgaccgatgtttgtggtcactgattacgctaagtccaatgctggccggttgcgttacaaagtccgcgacgtcaaccacttgagcaagaccgacggctggaccggctatattaccaccaactttgattatgttcgacccgtctactaccacagcagtcatcaaacactgacggtgatcaatccccgcggtgttaatgaatacctcaacaagaatttgacgggcaaagtgaagaacatcaagcagggaacggttcttcacgtaaccggtttcgtcaaacacaatttgaccacccgttacgttctgagcaacggccactacattaccggtaaccggaagctggttaagatgggtaaaatcaagcagcctcaccaattgaaagccacccacttcatcaaccggtatgccgatccaaatttggccaagcgaaacgggcacttcaagaaaggcaccaaactcgtgattaagcgttataccttcagtcatgaagcttcactgaccaagtccggaaccatgcgctatgctgtgaagggcggttatgtgactgctaatcagaagtatgtcaaagtgatcaaatagttcaaataacaccattggagaagtcaatctcaatggtgtttttgtttgccgtcagcaaggaagttactggcttttggtcccggatttttcacgattatccctccataacagtacgtttctgcaagctaattttgccaataaatacccaaaccaatatataatcattgtaagtaccaataagtcacgtaacacttctaggggggattttctgtgacacaagaattaggcaccaccgatttggggacatacgagtacgtttcacgggtgtacaacgaaaacattcagctgccggattacaaactgccgacgagcgtggctgatgggactcaggttttcttcgacacagacgtgatcaaattgtcgatggtcattgccgaccagagagtacaaaagatcacgattgtgacaccaaaaccccagtcactggagtacatgcgggtgtttgaaggcttcaaatttggcatggaagcactgggaacttggattaatacttaccatcgctcaacttccagtcatggcaaggccgccgacgtcgttaacggcatcttggccagctacagcaccaccaaagataatgttttgactgtcagcttaactcgggcacaataaaaatcgtcacgctatttatttctcaataaatggtgtgacgatttttttgattgcttagttaaattagttcaagccggagacttcggcgaatttcttggcagtccgaaccatgttggaaacgaagccatattcgttatcgaaccaggtagcggtcttaacaagttggaagtcaccgttagaggttacttcagtcaaagttgggtcgtagaccgccccgtgggtgtcgccgataatgtcagatgagacaatctcatcttcgttccagccaaatgccgggttatcaacggtgtgcggtttgatggcatcgttgacctggtcagcggtaactttggtgttgagaactgaaaccaattcgcaaactgaaccgtcaaccacggcaacccgttgagcatggccctgtaaatggccttcaagttctgggattaccaggccgattgctttagcagcaccggttgaatgaggaatcgtgttggctgaagcagtacggttaggacggaacttcttacctttagggccgtcaagaatcatctgtgaactggtaaatgcgtggatcgcggtcatggtaccaacttcgaggccgaattccttgttcaggaagtaagccattggtgccaaagcgttggtggtgcaagaacctgctgagatgatttgatcgtcggcatccaaagtatcgtcgttaacgttaaacacgatggtcttcattgggccggcaggagctgagatcaagactttcttaaccccggcgtccaaatgggcttgggatttttccttggaagtgtagaaacctgtacattcaaggactaaatcaacgccattttcctttacccaagggatgttacttgcgtctttttctgcataaacacggtagttctttccatcaacgaccagtgagtcatcggttgacgaaatctcatatggcagggtaccgtgagttgagtcatatttgaagagataagccagcatggatgggctggtcaaatcgttaatcgcaacaacttccaaatcaggatcgttgatttccaagatccggcgtaaaattaaccgaccgattctaccgaaaccattaattcctatctttaccataagtgaaatcccccttacaattctgatcgacagtcgacatgataattactttgtgtacaacctgttgtaatcatcaaaataagtttaagcggattgagggggaaattcaatcaaagagacttggcaatttgaactatgaatggcactcaaaaaaggccgccatgcaagtaaatcgacttgcacaacgacctcagcttagaaggacctaatcagattcttcaatattcaatttcattcgtttctgcagtctaaagttaatcacagtagcaatcaatgcggctgcactcagtaaggttgccaacaggaagtcatattttccaccgacaaacgaacgggcagccaagcttccggtaccattgttctgactgatggccatcaccgcagccataatcccaactccaattgagccggcaaattgctgaatcatactgaacaaggagttgacatcggcggtatacttccgtggcacgtttaacatggcattggaaatggtgttcgagaagcccatattgaagccaaaacgcaggaaggtgtagttcaacaggacaatccaggccgtcaagacggcttggatgccgaagaaaatcaggccgcccaacgtcattgaactgagccccagaataattggcaaggcgtatcccttgctgtcggcgaggtgaccggcatatggtgaaattgccgcaccaaccagtgatcctggcagcaagaccagtcccgcgatgaatggcgaactgtggagaacgtattggcaatagacggggatcaggaacgacacgccaatgttgacgaattgcaggacgaagtaggtgaacgccgacagcgaagacgacagccatttcaaaattcggatgtccagcagctgggttttaccatgagtgtcggagtagatgaagattgccagactaatgaagccaatgacaaacgggatcaagacttgcccgctcaacagtgagtatttaccggctttgctgacgccgaagacaaatgagaacagggtggcagccaggaagatcaggctgataacgtcaaagccgccggtgccgactggatcaatccgaatatagcgggatccgaggtaccagctgatgacgatgattggcagaatcaaccagaaaatcatccgccaggacatggtcgatgacacggttccgccataggttggcccaagcgcaggtgctaaagaaatcaccatcccagccagaccggtcatcgaaccgattcggcccgcgggaattttgttaaagataatgtggaacatcaacggcgtcgacaacccggtcgcaatcgcctggattaagcgtccgctcattaagattggaaaattcgctgaggtggcacacatgatgtcgccgaccacaaaggcaatcgcggccagtaagtggatgctttgcgatttgaatttcttaagcagaaaggccgttgttgccatgacaatcgtcaccatcaacaggtagccggtggtaatccactggaccgtgtccagggtgacgttaaagactttggttaattcgggaaaggtgacgttcattgacgtttcggtcaggattccggtaaatgagagcagtgcggcagccagcagggcaaggtaggtttgccggctgattttttcgttagtgttggacatgatttcatctctttctgattcaatagttaaaaatggaatttaatttgaattcttggtgatactttgaatgtcgacttttgaaataacggcgatttttgcaaagtcatcgcttgattggatgctgacttttgaaaaatagccgatattttaaaagtcgatggcaaatactgaagtgaatttgcaaataataccgatacttcaaaagtcgaggagttaagctgatcggacttttaaataatggcagatgctcaaaacttctcagacaaattccagggcaataaaaaagcgagtggcaattcactcactccggttcaagttacttgctggtggctttaaatttgattccaatccaaatcccagacaacgcccatggctttttcgccggtatggacagcgatcgccgggctgatttggtaggtgctgacgctggccttcgggaaatgctcatgaaaggctgtcacccaggctttacttaagtccgggttgttggcgtcaaccactgaaatccgcattggcgaatcgaaagtcgtctggtcgatggaattgatgatgtgctggagcgcttgtttcatggtcctctccttggcctctggaacgattttgccggcgtcgtcaaacgttagaattggtttgattttcagcatgttcccaaaaaatgcggaggtgttggaaatccggccggttctgcgcagatgatccaagctgtctacgactaaggaaacatgaatcgagtcgcgcagctgttcaagcttggggataatcacatcggcattctcaccattttcggccatcttacccgctaacaagcataagtcagcttcgccggcgctggcgattttcgagtcaaacgggtagaccttgatgttggtgacttggcgactgtaggccactaagttctcgtagaaggtggtgatgccagatgataggttgacacagatggcttcatcgtagcctttgtcagccaaggtatcaaaggcttcctgcatttgggccatggtgacttgcgcagttgtcggcaatttgtcagtctccgccaattttttcaggaattcttgcgaggtgatgtcaacgccatcgtggtattcctggatgccgaagatgatggtaatcggcagaacggtgatgttatattgggcagcgaccactggatcgaggtagctggcactgtcggtaattacggctgttttcatttcgattatcctcttttcggggttgtaattgtattttaacccttattttgattcaaaacaaaggaagtccacaaaaaagaagcctcgacgaaggtcgagacttcctaattcctacatattagtagttaccttgaataaccagtttcttgttagcagtgatgtaagtgccattgcttaacttgtaacgggtggtcaggttgtgcttttcaaaactcttaacggttacatgagtgcctttcttgaaggtcttagcgcgaccggttaagttcacgttcttgtaggcgtgaatgcctttcttgttaataacggtaatcttgtggctcttaggcattgtcttgtagtaaacgttgacaacgtacttcgggttggcggtaatgtagccaatcttgccagcggtcttcttaccgtggttaacgtcacgaaccttgtaacgaagggcgccaccattggacttgtcatagcctaaaacaacaaacattgggcggttaacccgcttagccttaggataagtggcagttcgttgtgacttcgtgaaattagcactgcggtacatgtagatacccttggttgcgtaaaccgctgaacctttaacggcggcgtagtttggtaggccggttccgtttgggttgcttgggtttgacgggttccaggcgctgttgccggagttgccgttgttgttagtgtttgaattgttattgtttgagttgttgcttggtgtgacactgcgttgacctacagttaccttgacaatcttggtaatgccgtcaattgtgtaagtaacatcatacgtactaccagcggcggtggtatcaactgctttgttggtagatacagtcacatcttttgataacggagttacagcattgccatctgatccgagatgtttggttaaaccattaaacttttgtgaatcccaattgctaccataaggaattgtaaaatctttagcatcgataaatgttttgtcggcgatagttgcggtaacgggaatgctgtccacaccatcatagctgtaaatgacctggtactgagctgggttatttgtaggcgtaactgacttgacagttgcttttgctacatcacttacggcgttaccatcagcatcataaagactaacgacacctttatttgtactggaccatagtgaattatagttggcatcattgaaatcttttgcagtgattgaatgaacaatctttaatgcgattggagaggaatatgttacctccatataaccttggacatctttcgaatttcgcccgatagcaagttgtgaaggattagaattagaagtgtccacttttagcggaactgataagttgagagtttggccggcacctagctcttcaggaccaatatatccattggagacatcttgcccgatttgaacagcccagaggttttcgttagctggatatgttactgaataagtatcaccgacagatggatatttatatcctaagtggaatggaccatcagttggctgggagaaagttggctttccaaccgttgaattgttgattagaggcgcagaagacatatcacccagacttggtagctgaagaacatcatatactttctggggtgtggctcccgtgtttgtaacaacaacattttctttgatgttggatgccttatcgacattaatcggtgtagcgtcacttagacttgggtctgctggctcattattactatattgatcagcagatacaagttccttttcgtttccattaattgtagctgagaacgagattttcgcgctgacaggatttgaatccgcagcagatgctgtccctccagcagccactaaaccaagcgttgctgcaccaacaagcgtaaaggctgcttgtaagatatgacgacgcaaattatgcttcatatttatcataaaaattcccctttcaattgtccctcaataattatatgtagcaatatctgatacaatggacaccatcttctcttctgctgatacaatggacaccatctactctgcctctacagcaatggacaccatcttctcttcatgagacactatcctgttgatacagtagtcaccaactactactgaaatagaaactgtaccttcttctactacgatggacaccatatcaccgtctttaaagacgctactctcctgatacaaagacacttctcttctgatataagaacaccttcacttcttcttctaggacacattctcatattctaagacactactcttctactattatgacaccttctctccttcttcttctactataatgacaccttcacttcctctactattaagacaccttcacttcctttaagacactactcttcttataagaaacttctcttcttctgatacaaagacaccttcacttcttctactataatgacaccttctcttcttattatgacatcttctcttcttcttctaggacaccttctcttcttcttctatgacacctttacctcttcttctaatacaaagacacttctcttcttataagacactactcttcttctaagacacctccgcttcttcctgcaccgaagacactactctcctgatataatgacatcttctctacttcttcttctactataatgacaccttctcttctcattatgacatcttctcttcttcttctaggacaccttctcttcttcttctatgacacctttacctcttcttctgatacaaagacattacttttcttctgatacaaagacaccttcacttattctcctaagacacttcttcttctgatacaaagacaccttcacttcttcttctataatgacaccttctctacttcttcttctactattaagacaccttctcttcttcttctgatacaaagacactactcttcttctactattgtgacaccttctcttcttctacttcttttaagacaccttctcttcttcttctaagacaccttctcttcttcttctaagacaccttctcttcttcttctaataaaacgacaccttctcttcttcttctaagacaccttcacttcttctcctaagtcaccttcacttcttctaagacactactcttcttctgatacaaagacacttctcctcttctaataaaaagacaccattacttcttctactattaagacaccttcacttctttcactattatgataccttctccgcttcttcttctactattatgacaccttcacttcttctactataaggacaccttctcttctcctaagacacttctcttcttctaataacaaagacaccgtctcgtcttcaggaacactactctactgaactactcacacctctctttctccgccattacagttcacaccacgctccaacgcagcataccacaagacatacttgcatacaagcccactgttgcttctgctgcccctctctggccgtgtggcgactgtgcccgctgctgctgccccgactgacgccaaaagccactatgaaacgcgtcgctcgcctcagcgcgcctgggccgcagacacttctcggtgctgctcgcggcctgctgctggtggtgccaccaaacgctggtcaacgactgtcgaccactgcttgataccaactagccttccatcggggcccttggcccctctgggcgtgcctcaaatcattatgtaaatccccatagttaaggatattgatatgcatccactatagaagattgatattccgaggcgatattacattcgctaacaaaactcacccgcgcctcgcgtcatatcgatcgatataccatactaatttttcaaggccatattctgagagcagttgtatttgacagtattattgcaaggttctattaccaatgttgcccagaacatgctgctcaaaatagaagataaggaacactcgatttagatcgagacattgtcagaacggccgctcattagtatgatctggacatcatcataaacgaccatccagttttacaacacatggtgtatttattcatgtgtctgactttagctcttgatgttcagaacattcgggagagatattgacgtcgaattctgcaatggacagctttataccacaaatattctggagtcgtgagtgatttagtttcagcatttagagcgacgtgtaccttttctagaagtctcttctctgtgccaatgtatgtcgggtataaagctttagtaagtgcctttggataggtttgaaggaacaggttccaatagattccaagatttcaataggtccagcgttacaagatgagtggcctcgtggtgacaatatcagaatccggcaaaaatttcttccgttattattgatagtaatgacttcattaaacaacatttggtgaacgcccgtcctaaatttgagaccttcggtatatgaatatcgtccctttactagcaaatatgctgacgcttcgaacgtctgtttggcaactgtgcagcaactttatgtaacctttcttcgtactagcttcgcataccttgtcatctactttcaattaagttccagtttgtcctagtgagtgggaagacggatttcatgcttgcctggatctcactgaagtggtacaattgcaagacgtttcactgagtttcggagacgggttcgctggaacgacaatattcaaagtgttcacaatccccacgtgagagaagtaacatatctcatgctcttaaatttagtgctgttgtttaggtggagtgcgctgtgtcagtgtggcaaccctaaggtgctcgtgtgtgtcagtggctgcatctggccaatagtccctcgtcaattccttaaggcctgctgcttgataaaatccgctgaaaactcaagtccaaaattgtgcaatctctgaaaaaaatatcgactcaggaaaagtgcaatatttcggctatttgagaaaacttgaacactgtcggctagtacctagatcggctaaactgccgttttagcctgcagaggacccccagaactgtttttaatactcttccctcaatgactggtcttgatggccgcaaatctgcaggatcatagctggtatattcccttggacgtaccagctcttacttatgagatttcttaatgcgatagttaaaagttatacagcaaagaggtgatcttgtttgtagattagtgtcttctatagaatgcagcaaaatagcaatattagttgaagttgctaaaccacatcgaatactgatcgatcatacactgttccatcacatcaaggtttcgtggaccataaccaactgcaaagttgaagactaacctataatatttatcactggagaacgcagtgttatgatgtgactgtccgtatgttggtggtaaatctgatagcagttcatggtcttggttttgtacaatctatgttgtatctcagatacttccatgtgaggacggttcctcctgcttttgtatgaggctagagtctctttcaaaatcaggtggtaaatcgtcagcatctgattagatacgagccatttatgggcataaattgagccgttgaagcgatgtttcggtgtcacggtggatacaatttgaaatctccaaagcctagttcctcttagtgtgtaactaaaattgagcatcctacacagatcaaatgcaaagagctgatgtatgcttatgctaatgactcctgtgtaaatatcctagtaagcgtgcgtgcttttcaatgcacctccgagaaagagcgcacgatgagctaaagacaatcaactattagtggccggttgattgttagatgaaccaagtagaaacaaacatgagtttagacagccacataggtagcttcaacagacaaacagttcccaataaccatttcccttctctctcatggatacaagttaggaggtgctaacgagatggatcattcagtcaaaactaaaccgcttgtaggaaccgcatgggcgctgaatataggtattcaggtgttcctcaaaacgaaaaacaattcacaatcttcacttctttttgattgcaagacttgcttcgcttctttgtacagttgtactgtagtcgcaatcggtacaacaaaggctacgtccttcatgtggcgaaacttcatatccttgaactctcttccgaatcctacctaatagtgttaaagcactttgccatcgagcggagtgggtaacgttctcctggttaaaatcgtgtgatcattcatggtccttttggatgccgaacatagttctactccgtaaagataaacaacccattaactgctgcaagacagctgcaaccaaacaccatcaagatcttataatgcgattgaaacaaatgtgagacataggtagctagtgtggctacttgctattgatgatgtggcattcttctatcagttctgtggtagagttgcctcataggacaacggtgcgtaatggaggagcatttccatctgaggaacttctgtctcgtcatgttatgtaagaggtcattatcagttactccacaaatagctgtggctcttcttagtcattagttatcgaccttttcccttctatgcttcctcatacatggcctttgcaactacggtacgacgtacgacgcaaaaacggcaaacactggacgactcttcgcacatccgaatattatgttcctaaaaggagaagttttcgcgatagccaaaaaatatggtgaaacctcaaatagccgagcagctacattttctgtgtcgtatatagaagatgatgtaaaatgcacaacaagacttaaataaaggtattgtcttgttgatgtaagtaagaatagaccaataaatactttccgtgggaaataagttattgtattactcttgatatggctatattcacacattttaatgttagtagtgtgtttttggaaatctaatcctacaatttttaagagattgaaattattacctgaaataaaaaggccaaatatagggggtcctcagaattccatttttgacattttcagtactttagcaaagccgtagaatttgaatgatctgcttttgaatagatttgacccaataaccattgagatataacactttgaagtttttggctgagcctccaaaatgaacagtttttttaccgagtctcagaacgctcagaacgggaacttatcactaaaaccattagaaagattgaatgagaaagttcagattccttttacagtagctttcagctatgtacgaggctggattatgttataataacaggacatgtgaatgttgcaagttaggtctccataatcgtacccaagatagaaggtttgccgataaccgatagccgacagtctccattttttctcaaaaagccgaaaaattgtgtttttcctggatgaaactaaaaactctgggtgagtggatatctctggattcgggtgggaggtggaagtgagtggaggggaaataatcatgcgagaatcacttacttagcgctcaacacttcaaagcactttagggaaggttacacgggtggtaatgtctcagatagccaataaagtgcacagtgactagaagcgattttcatataggcagataatatatgccttgtgttgtatctacaatatagtttagcagctgatagtacagaactgtgtacatcaatctcagtcatagcttttctttgacaacttgagaaaactcttgcagttgaattagattccagtttcattttagaccagtggatagagctttgctcaagcaatgtatgttccaatttcataacgtgatgacaacttagctcgatgtgttaatatcgaggggttcaatgatgggctatgatttgatatgccacaaaaccttgctaggaacacagttacaagactttccgcagtactaggaagcattgatgatgagaagagggaatgattacacacactagtactgaatatcatttaccaacttacatccacaattattatggcccctgactcaccgagattggatttgcgttcactacgattcctcaaaagggtagttctacagctggggcactttttttctcgattgatcggttactaagataatcaggccttatccatcagatcaatagatagatccgtttcggcggtctcttcggtacgtggccgatgatatcacatggggagtcttcacagggtggtggtcttatagagctaggcaagtaggtgtgataacctgaccagctacatcattcgctagcactgaaggttgagcgtccaccccctttactcggcaaacaatgtgctccgtttgaggagactagaggcattatggtaatccccagatctgtatagtagatgttcgatcgagtctaaaggacttcatacagtgctgcgtactgcgtctgtttacttggtgaggtttaatgttacctatcataattatctctagtatcgactagttggcagaattttggactactactaggctggaaatgcaatagacgatatcggcttttagttcgcttcccccggctttatataatgcacccttcagacatgcaagacatggttgttgggaaattgaatcgattgacgattgctccactctcaaaactaaatgttgagaggcagtgagcacttagtaaacgaactttacgggagaagagaagacgcaatgataaaaaagcgacgaaaattgtgttatactaatggtatgaagatctatacaagacgaacaaaccaaattggaagttacgtatgaagtttatgtacgaggtatgttactgtaacttttcagagctcgcgccaaaacgttcttccaatctgctgaactggttggatgaaacagacatcaactcctctctcattttagggttcttgaagaacagttcaaagttttcaacgtctgcccattcttcaacaaacttgaattccaacatgccaataccatcaggaagaccgccaactgggaaaatcaatgtaattatgagaagcaccgaagcagcagctgcgtaacctgtgaagtatgagaagtagtagacgtacgtagcaccgattggaaccacatgtgtttcggttgcaccaacaaaccccacaatatttggcagaataccacaaatgtaggcaaaataagccctccaatttacaccatgagaatagtagtatggtgagcttccatccgcaacatacaagtcttgtacttgtaaataacctttcttaatgatgaaatagtcgcagaacatgacacccgcaatggatgaaagaaagacggagtatgcacttaggtaggtagtgaatctcgaggaggatgacattaagttccaaggacaaatagcaaaccccactgctgcacaaatgaaaccacctcttctgatattgatatatttaggtaagagagcagtcatgtccgttccagcagaaagggagttagcagaaatattggtaccaacttgggcaatggtgaaacaaaaagcaagaatgaacacaccaccacggtcgcctcttgaattaccatccaagaatttcgaaaggacatccaatgggttccaaaaggtttcgttatatagatatgtggaagcacttgaaacaaggacaccaatcaaacacgtgatggagaagcaaattggtagggtgataaattgggaccaaattgcagcgttcggcttgttagcaaaccttgaaaaatccggagcattaacaatcaaagtggagaagttagccaaagcgttcatgacagagttgatgaatgcccatgcaaaagctgatcccgaaactttgcttggttcgtgaatgacaggcccaccaccatcggccttgactaaagtccaaataaggaaagcaacaccagcaatcggacagagaacagccttaacagtaaataaatgacgaaccacatgaggtgggaggtagacgaatggaagttggaaaagccagtaaaggaaaaaacttagcaatttgaatgaagttgtgtcaccgccgacatggttaggtatcctagtattcaaatcattaccaaagatagctctaagcatcaactcgacacagttaccaccaatagtggattgaacaccaaaccacacacatgccatgacaactctattgagaactggccacaaggagccccaaatgccaaatgatgatctgcacgaaacagggaaggagatgtgatatgcgttaccaactttggcagcaagagtaaggaaacagccacaaaagaagtatccaatccaaactgtaatccaagtagcccaccaagaaagacctgctttgacaccagttgccgcaatttcccaagtattgatattgaaagcttctgctatccagaaaaagataaaatggtaccatgcccatttacgtctcgcagcttcaacaggacgaagatcatagttgacaagaaatagctgtgacagagtcaacccctcagtgccttcaatttcaagccatttagagagtctgatgaatggattggttgacttggtcttttcctctccgctgaaagaaggggttccagagcttgaaaactcattcgacgtttcttggtaaacttcagcgtattccttgttcatgtcttcaacgtcaacgtcaacgtcaacatcagcatgagacgactcagctgcgactttgctgtttgaggtgataccaagcatcttagtttcacagcttatttgaaataggcgtaaagctcaaaatgaaaaaagatgtggtaggtaaaattgcactaactttcaggttagggctggttgtttgagtggattgatgataaaggaaatggtatcaagatccaggaagtatggaggctgtttggctgcactacaacgtcttctaaaccaagttcagagaggaaagggaaaagaggcagtaataaagcttcgtcacgagctctttagcatgagaattttttttggaggcagctcgcaaaaactcgatctacagccgcccatgtacaacgccataaaattatattctgctcatcgcgcgagtgacaagctgaaaattgtgtgtgcaggcgttaaacttcattcagttttgacccaaaatggattttttttcttatcggacagctcgcggctaaaattatccggcctaaagtggaagcttgcgaacggaaacggaaaaccttttcttttgcgagcggattaacacattaaccgacctgccggttgcttccaccccggcggtttacgtgtcggcttatctatacacgcgccgtagccatatgccaggtcgtttgtacactccgaagcaggaaagatgaaagataacaaaagacgatctatcacacatgagatgagatatgaggttttgcacacgactgatctcacagaagaggtgaaaatagccgtgtagagtggataaagaatatccggagatgagacatgagctcgctgcgttttccatgattggctattttcggctctagctagttattatccgaaggacgcagaaatgagaagctatgtcatctctcttacgagtttccctagactaaccagatacgagccagacacactgagtcaatagcatcgctcagaacccgctgacattgcacgaagctggcgaaaatcgcaagagtaagagtaaccgtatagcttagagtgtgaggatgaacaataactagggagcaaagacaagaaggaaaatatagataatatcactgcgctgggccatagtcgtttattgccaaaccatgttcttcctatacttctaatatttcgaattatggttcaagtaaccaagcagtacatcattgggaacagttacttttattcactccatggaacactggacccagcctttaatttcaaaagtatagttacggtctcagctgaattgttattgctgaaatctaaaagaaattattcaaggaaccccttcttaacgttgagtgtcgagtaagaccttaggcactgtttttttgatctttttttttctgatctcgctggttttgaggaattttttaggggccaactctaagttagctttgaattaaaatgatcctgcatatgatgacaatatggttggttggtttacatggaatgagcaggaaaggggctacataagagtagcaattttatacaactgatccttccatttaccaactttttgcttaatcagatttatgttcgcctatatctcaattttttctggtagctaagtcttttttccttaggtacatttacatcctatcttgagctaaatagctcaggcaattgggagatacggcacagagcattctgaatagtaaaggtatttgaaaaaggacatcgtgtaaatgttacagattactcttcctatggtgccttcgttaatatatcttggtttatgtgataatgcctggtttctggctagtagtatcacgcatttacccgattcacagtggaaaagcttaccttgcattccagttaagagttaagagggtcccctatcgtctacgctagtctttgtatagatcttttgtcaatcaattacataaccaacgacgatgctacgatactactaatcttgcgatctttttacagcttatttgaaaaatactgagaaggatcgatacaatttgagcaatgttggttagtaaacaagaacttttatagtgaataaactgttatcggagtgttgccacttgaggcctgacgcatgcacttatgcgcacgagtccagcctgaacaaaataggaaagcattgttaaactatacatgttcaatacatagtagagcgccacatcgagatactggtacctatataaagataaagccagcagaataaatcttgcaggtgaatggggtctgcctatataccggtgtattccactatacatgtagtgtgtagtgggtttattaatgcagccgcttgcttgccgtgcaggaaggatgcatctgcacgcgcgggtgtggctccatccgcgaaaagtgagatggtttattgttgttaacttgctgataagggatcaagtacatgcacatgcatcacaaagattgcgtttttcggcccgaacctgcctgcctatatagataaaatcacacatgtgtttgtggtgtgtgtgtctttgaccatagttagtacacatcggcctgcttgagaataacgtgcaactgtatacatgcgcgtgcctttagctgtattatatgacggcctttcgcaaatatccgtgtatcagtcacgcgtgggcatgcggctgaacggcaccaaaccgtttgcgttactgcgataagattgtttgttttcggcgaatattgttgcacatttcagtatcgatgcatgcagctccctactcaaattaaggtaatatcgacatgaatcactagaaaatgcatttgatagctttttacatcgatatgattgtagttctatctgttttctcccttcgaagataaacacgcgctccacaagtaggtatactcttgcttgattgccatattgataacgtcgatatgaacaaattcaatggctgtaaagataaggttgatatgatttatttactctgatgacagtgaagataagctgaacagaggataactagatggctgtgaagatgttatcgttgttaggtaattaaattgctgaactgataactagaagaagcatcaggcgtcttctagattcctgcaatatataacagttgataaatccctctccccggtattttctcagcatgaagtttctaaaagatgatttccttcaatctttcttattaaacaacaatctagggctgcaagctgcaacacttctccaaatggattacaaagaaaaagaggtctttaaagcctcggagaaacaagaccacaccctggaggttgatattgtttcgctcgacgactcatacaagcataaattatacgagttcttgggtcatggccacattctgggcgacgagccaattccagacattgagtttttataccagaagatgcaagaaaccactattgcagaggctttgaatatcttgaggcaggtcctcattgaacacgatgatgatccaaactatccacacgaagacatgtcggtaattcgtgagctcgttgcttcttttgaagccgaagttacctcggagggtactcccaatgagaagccagacatgattgaatattacgactcaagtgactccgactccgaccgcgccttctacatgaagcttcatgctatcattaacgagtaccattctccatacccagaagttcgtgctgttacctcccctatcgatgataccagcgcgcctgtggaaaccatccgttcttacattattgctttggtatgggtcattattggttccggtgtcaatgaattctttagtcacagacaaccttccattggtctaggatcttcggtcatccagatgttgatatacccaacaggtaagctttttgaaaaggctcttccagatgttggctttactgcctttggctccaggcactcattgaatcctggaccatggggttttaaagagcaaatgtttgctacacttattttcaatgtttgctctggtgtctatgtttcctacaatatcattgttcagaagatggatcggttctatggccaggactggatttcagttggttaccaagcattacttgcacttggtacacaaacgcttggttttggatttgccggtgtcttgagaaagcttgtcatctacccaactcgtaacatttggcctaccatcttgccaactattgcattcaacagggctttgttaaaaccagagagtaaagaaaacatacacggctggaccatcagcagatacttgttccttattgtcaccggtgctgcttcatttgtttacttctggcttcctaactacctcttccaggcactctccacattcaactggatgacttggattgcacccggtaatttcaatttggcaactatcactggcagtgtctccggcttgggtgtcaatccgcttcctacctttgattggaatatcatcagtttcaatgctcctttaatttatccatttttttctcaaataaatcaatttgccggtactatgattgcattctttgctattgttggtgtgtactactccaactacttgtggtctgcatttcttccaatcaacagcaactcaatttttgataatacaggtggcccatatgaggttcaaaatgttgtgaagaatggaaaatttgaccttgctgcttacgaaaagtacggtccaccgtactacactgcttcaaacttggttatgtatggtgcattctttgctctttacccattcagtttctgctacacagtttgggaagactggttcaacattcgtaaggcgttatctggattccttgagttattcaagaacccaaagggcttcttcctcaactccaacttctccaacttcaaggatcctcactctagaatgatgtctaaatacaaggaagctccagattggtggttctacattgttctacttgtttcccttacctctttgagcctggccttttccattccagtgctgcttgacattattattggtgggattaccttctcaggctcgctaattgcaaccggtaaattgtccggacatgtgcccggcaaaccaatttcgtttcccggcgacaaattgattaacggtctggcagtgttagcaattatcgttgccggtgtttggatgattggttttccttccgcttactggcctatggtactggcattgttagccagtttgatttttggcctattgatgaccttgccaattggtggtgccgacatgccggtggttgtttcacttttgaacgcctttaccggtttggcggttgcctttgccggatttgtcattgataatcaggtcttgattatcgctggtgcgctggttggtgcggccggaacaattttgaccctgcaaatggccgaagcaatgaaccgatcagttgccaacattattgctggcggcttcggtagtggcgattccaacggcagtattggtgcgggtgctgaggtgccaaccaacattaagaagaccacacccgatgatgtcggcatgcagctggcctatgcgcacaatgtcatgatcgttcccggttatggtttggctgccgctcaggctcagcatgaagtcgctgagttggcgaaattgctgacggatgccggaattaacgtcaactatgcgattcacccagttgccggccggatgcctggccatatgaacgttttgctcgccgatgtcaacgttccttacgatcaaatgaaacagttggatgaagccaactcgatgtttgaaaatactgacgtttcgctggttattggcgctaacgatgttaccaatccattggctcgtgaaaagggtaacgccatttcggggatgccaattttggatgttgataaatcaaagtccgtcgttgtcattaagcgttccatgagtaccggttacgccggtgttcaaaacccactgtttagtgaagatcagaccagtatgatgttctcggatgccaagaaggggctgcaggaaattattgcggctaccaaggggtatttagattaaatgaagagtggggcgcgaggcgctttgatcccagaatttaagtaaataatccagttattcctggttttggaataactggattatttgcttaaatggccgggatcagccgattgtcccaggtttaatctatatgacagtggaactcaaaagaggcgatgacataactgacaaagaatgatgtttcgcctcttttgggtaattatttataatagactttcacaaacttcggattggcggtaatatagccacccttgacagagaatcgcttggcaccggacttggtgttcgacgcatcatggctataggtgtagaagttgactttaatcttggcgcctttcttgtagtgaccgtttttcttggtgaaattggcagtggtatagcggttgattgcttttttggcgaccactctggttggctgcttttgtttaccgttcataaccagcttacggttggcagtgatgaaattaccattgcccagcatgtaacgggtggtcaagttgtgggtggtgattgactcgacctttaggattcttccctgcttgaacgtctggactggcttggtgaggtccttttcgttgtattcgatgactccatttgggctgatgacggtgatgaactttgggactgcctggtagtaaaccggagaaacgaagctggacttagtggtgatgtagccggtcattcccgcagttggactgtcatggttgacatcgacgactttgaaacgtatgcggcctgcgttggaatagctgtatccggtgaccacaaacattggtcggaagacccgtggcttttgagtataaccaaccagtcgctcagcttttttgaaggttggattcttgtataggtaaatcttcttcagtgagtagacgacttcaccagtagttttcgcataatttggtaactgcgttccgcttggtggggttgggtgaactgggaaggttggggtttccggattggttggtggatttggtgtggtcggtggcgtcgggttgaccggtgttgaattcttggtgtaaatgagcttgaaggtttgcttttctccggtaattttgccggtttgtgccggatcgtatttggagaaggtgtaacctgggatatttaatttgtaatcggctgttgaaagatcgaaggcttgatcaatttcacccttgatcgtagctgacgcatgaattgagttgccgttggtgtcgacatactcaactgtgaccggctgggcttcttctggttgaatgacgtatggcataaagtagctcagtgctgcgtagagcggttctcctgggtagacgttatattgcgcaatcatgtagtaagtgtaggtattgttaacaacggttgcgtttggatagtagctggcccatgggttagtgggatctgtcgggataatttgcggtgccaaatttgtgtaggtgaaatcatcaccgttaatggttgtggttccctgggccacaccagtcccacgagtgccgttgcggaagacgtcaatttgagagtacttggtatcggttgggttgccataagcaagggttcccggacggagaaatttttgctggtaaggctggaatggtttgttatcctcggttttaacgttttttggtaaggcgtccacaaacggtgctttccaagtgtaggtgttggagtggagcacttgtagtggtttaatgacgatttgctccaggtagttaaatccctcggtatattgttcagcgtccaatgtgtttagattattgatgcagttgttattgagatataaagtcttgacattcttcagacccgcaattggtgaaatgtcttgaattcgattacctgacaagttgatatattcaagtttttccagaccttcaagtggtgagacatcaataatgtcatcatgatgaaatttacttcctctatttaagtctgcgttcaattcaagcttggtgaggttcgtacaatattccaagccttccagtgaataattacccttatttgcagggccgaccgaaccgttgccgccattgaccggttcttggcggtccacttgttcgttggttccaatctcccagcccagctgagttagttttgccaaatcttccttaaatgtggtcggcgtgaagtcactcaaggtaaagttgggatcttgaatgatcttttgatctttcatattgattaaaactaattctcgcagtttctcattcggcattattttgtcgatggtctgttcgtcttgagtagtggctgcattggcggccgtgaccatcggcgtttggttatttaagaccatccccacaaacatcaggatggcggtcgtcgtgatcattaacaaaaagttgagtagtctcttggaacgctccatgattattcacccccaagtgtaaatattccttccttgtaatcgctttcattatatcggaatattaccagaaattgaaagtatcttgattgtgaaattaagttcttaaaattaccggtctcagcccatgaacgcgggcaattggtatggtaaactaatatcaatagtacgtaactaatggttaagaaaagaaagggttattagatggcgtttgtgggtcaaattgcactcattttaattgcaacattattggcggcagcgattagtcaacgattagggatgccggctgtgatcggccagttgatcgccggggttattttaggcccgggtatcttaggggtcctgcacaatacggaactgatgcacgccggggcagaaatcggcgtgattattttgatgttcattgccgggatcgaaagcgatctggatttactcaagaagtatttcaaaccggcaattagtgtggcggcaatcggcgtcttgttccccatgattgtcttttacggctacggccaaatcatggggcagggctttgagcgctcaattttttggggcgttatcttcgcggcaacttcggtctcaattagtgtcgaagtgcttcgcgagttcaagaaattgaacaccaaggaaggcgcgacaattctgggagcagcagtggttgatgacatcattgccgtgattttgctgagtatcttcgtcagctcctttggagttagcggcagtggatcgtcgaatttactggttgccacactgtatcaattgatgtactttttaggtgtgatcatcctggttaaatgggtggtcccggtggtactgcgagtggcagaacgattgccggtccacggctcggtagcgattacctcgctggtgatctgtttgacaatggcctggtccgctgacgctttaggcttgagttcggtggttggcgccttctttgctggggtggccgtttcacagacgaaatttcaagatgaaatctccagtagtgtcagctcagtcggatacacctttttcattccgatcttctttgtcagcattggcttggatatggagttcaacaatgtcatcaagaacctgggcttcattgtcatcatgacgattttagcgatcgctaccaagttgtttggcggcgccctgggtgcttggatcaccaaaatgaattggagcagcgcgtttattgttggttccgggatggtatcacggggtgaaatggcgctgattatcgcccaaatcgggttgtccgccaatttgatggccaagaacctgtactctgaaattattattgtcattgtattgtcgacgattgtggcaccaatgttattgaagaaaacaatgaaagtttaaaaggagattaatgatggttactgaatatgcgagtggtgcagtggtttatgaaattagagacggcaagatctggtacctgttattgcagagtgccacctctgatttttggggattacccaaaggacacgtcgagaagaatgaaaatctcatccaaacagcagtccgtgaaattcacgaggaaaccagcttaaagacgcaaatcgacgccaactttaaagaaaaggttgagtacgatatgaacaacggccaccacaaggacgtgactttctttgtcagccgggtggcgccagaagtcaaggttcgaaagcaggatgaagagatcaactcatttggatggtttgactatgaagatgcttacgaaaagttaacctatgataatctccgacaactgcttaagcacgccgacacctatatccgcaataaagaaaacatcgaggaagcctgatgaagaatcgagtatttgtgattaccggagccgctggcagcggcaagacaaccgttcgtgattatttacatgaccaatatcaaatggcccgggtgatcacccacaccacccggccgccgcgggaaaatgaacgtgacggggtggactattattttgaggacgaccaatcgttctttgacaatcactttttggagtccgtccactatgccggccactattatggttcatcctacgaaggcttagagaatgcctgggagaaatcaccatttgcgacgattgtcctggacactgccggagccattacatataagcagaaactgggcgaaaaggcagtcatcatttttctgcaggtcggcgatactgaagaactcaaacgccgaatgcaggggcgtggtgacaatgctgagatggttgccaaacgggtcagcagtaaggagtatcatcgtgatctcgaaatgccttatgaactgcagggcaaggcttatcaagtggttaaccaggattggcagcagacgcgtcaacaaattgataaaatcgttgagaattatcgtcaagaaacggcgggatagttgttgctgaaagtagattatggtaggatgcaataaacagtaataattacttattagaggtgaacagtatgcctgcagcaattgaacaagcgaccaaagttttaaaagagaataacttcaagattaccaagcaacgccgcgcgatgattgaatttttagtcggcacagcgacgcataagtttgttgaagtcaccagcattgatgatttcatgcgcaaaacctttcccaacatgagtcataacacgatttaccgcaacatttccgagtttgccaatttggggattgttgagcggcaggtgcagggtgatcgggcatcagttaaattccagtgtgattttcaacatgagcatcaccaccactttatctgtagtaactgcggcaaagtgatcgaactcaaggattgtccattgagtcctgaaatcacttcccagctggctggctgtgaagtgactggtcatttgtttcagatttatggcttgtgccctcagtgcgtcaacttaatgaataattaacgaattgtttaggtttcgttcatattcttatgcgataatggaggctacaaaaatttagtaaggaagttttttgaatggataatagaattccaccattaattacgccatttgccattctctcaatttctttggcactcggcgccactaacgttgtggtcaataatgtgacgtccaccaatgaaggaacccctaggaccactcaaacgaccaatcaaaaaaagatttcggattccatctatgggaataagaaaaagaccaacgattcggatgcgaaagaaaaagctgagaaggctaaggaagcctccgaaaagaagaaggccgctgaagaatcgtctgcggccaaggcttcgtctgaaaaagccgagagcgaaaagaacgccagctcttcagatgatcaaaccaacgatgatacgaccaataacaacaagaatacgacaaccgggacaacgaccaataaaggaacgactaccaataagggtacaaccactaataaagggacaacgaccggcggtactaccactaataacaataattccgatcaaaatacccagaccggtagtgaaagtagtagtcaaacaaccgggacaacgggcggaaccaacactcaaaataacaataatacgaatgccaacgctgatgtgacgactggcaatacaggggagggaactaactaatgtttagctttttggacatggttaaccactacctggggtacttcaatattaatgtgacccttaagagccggatttacacagtgttaggcttctttggtgacgtctacctgttttacatcagttttcgtttcttacagaatcagatgtttagcaagggtgtcccgattttattagtcgcaatcattttgctgtactttacaatttgcaacttcttttattactttactaagaagcagccgtggttcgatatttcaccgaaaattgccaagctgctgcacattcaagagcacccacgagaaactcaggtgcaatccaaaatgggcaccaccgtcatcgctgatgaacgaaacgtgccggctaacggcttgttcgacgaccaacacctgttaccggctaaaattgaggtcagcccaatgcagcaggctaatattgatcgactggtttcccaaatggaacgccaacagctgtttaaggccgactataacggcatgagtgaccggaagatctatgaactgctgaaggttaatagtaagccgatttatgccattggcaaaggcgtattgcttccttattttgaaatgcaaaaacaaggttcgtcattgatggtctattgcggtttgaaccaagcagagatctatccggtcggcgaaattaagcggattggcctgcagtcgattcgatcgcttgatttgagtcaggtcaagttatacttggcatcagtgaccttagttggtggaccatacaagcagatcggccgggctggggtgattgaagcgccacaagactataagctgcgggcaatggttgcttacaagaagttataaacgaaagggcctcattatgagaattaatgttttacaacacgccgccgatgagggacccggatccattcaggactgggcgcatgccaaggggcatcagatgtacatttatcatccggatcaatttggcctactgccaactgcagctcagactgatatgttgatcattctcggcggaccaatgagtcctaatgacgatttgccgtggattcaacaagaacgggaattgattcaacaactgttggatgctcaaacaccaatctttggtgcctgttttggggctcagcagattgccaaagccttgggctacgctgtttccaagggtccggcaaaagaagttggttgggccccggtgtatcgaaagtccgacgtgattcctggactacctgagcaattgacggcgctgcattggcacgaggatatgtttgaacttcccgatgatgcagatttattgttctcaagcgaccacttggccaaccagggatttgtgttgaatcaccgggttgtcgggttgcagtttcactttgagcccaaagaagataatgttcgcgagatggtcgtcaatgacgctgcatacatccaaggttcggtgttgaatcagtcagctgatgaaattttggctcgtcaggttccagcagaaaataaaaacgtcatgtttcaaattctcgattacatttctgaaaattaatattttctcatcttaataacgtgcaattcaacccgggctgggtttggattgcacgttatttttgagctctcattttttagccacaaaatgagcttccaattaaattttattcaaatggggtttccattttcgctgatggtgaattataattagataattacccaaatttatacatccaaaataatggtcgagtttgaatggctttatcatcggattaactccgttgatagaaaatgtgacatggagataaaatttttgtaacatttttttgacctatcaaaatttttaacatattatggatgtagtatcattcttaggcaattttaataaatagcctgaaagcattggaggaaaatgacatggcaatgatcgaatttcaagacgtacaaaagtattacggcgatttccatgctttaaaggacatcaatttgaagattgaagcaggcgaaaccgttgttttaattggtccttcaggttctggtaagtcgacactgatccgaacggttaatggccttgaaccgattcaagaaggtaagttgatcgtcaatgggcaggacttggccaacaagaagaccgatgttaaccggatccgaaagaacgttgggatggtgttccagcattttaatttgtatgccaacaagacggttcttgaaaatatcatgttagcaccacgaattgtgttgaagcgtcctgaaaaagaaaacaaagagttggcaatgcaattgctcgaccaagttggtcttcaaagccaagccaacaaattgccagcccaattatcaggtggtcaacagcaacgtatcgcgatcgcccgttctctggcaatgaagccaaagtgtctgttgtttgatgaaccaaccagtgcgttggatccagaaatgattgatgatgttttgaacgttatgaaagatattgcgcaagattcagatatgaccatgttggttgtgactcacgaaatgggatttgcccgtgaagttgccaaccgggttatctttatggatgacggtcagattttggaagatgacacaagcgacaaattctttgatggtgaaccctccaatgaacgtgcacgacaatttcttgggaaaattattacgcattaaaaatttcattattgggaggtcgcatcatgaagaagatcatatcaagaattgggttattattaaccctgctcttaatggtcgtttctttgagtgcctgttcgagcgcagcatcacagaaaaatgtgctgaaggatgacaagcagacaaagacgatcacatggggcgttaaagccgacaccaagctgtttggtttaatggatgtacgggacaatcagatcaagggatttgaaattgatttggccaaagcgatgaccaagcagattcttggcaaagacggcaaggcacgattcattcaagtaaccagtcaaacccggatgccattactgagaaacggcaacattgatgctattatggcaaccatgaccatcacccctgagcgggccaagcaagttgacttttcacgctcatactttgatgccgggcaagccatcctcgttaagaatggtagtccaatcaagaatgtgaaagatttgaaccataagggcgccattgtccttggggtggttggttccaactccgttcaaaatattaagaagtttgcgcctaaagccagagtgcttcaactgtctgattattctcaggcgttgacagccttgaaatccggtcagggggatgcattaaccactgataacggaattctttatgggatgtccatcgaaaacccaggttattcggttgttggtggcacctttaccaaggaaccttatggaattgccgttgacaaaggccaaggccagatgagagacgcgatgaacaacgccctgaccaaggttgaaaattccggtcaatacaacaagctcctttataagtggttccacaaggttcacggatttgactttaagggggcagaacgatgataagtatttttcaaaattatggtggtgagctcctttatggactgggacaaacccttttgtgctcgattattgcgttgatctttgcattaatcatcggctcgggttttgccatcctggaagttgtacccaacaaattctttagagtgattgccagagtttatatcgaagttttccggaacattccattactggttatcacgatgttcttctacgtggttattccaatgtacattgttgaaatcagtggttttgcctctggtacgattggcctgatcctttactcgtcagcgtttatcgctgaaaccgttcgatcaggaatccagtctgttgatcctggtcaaatggaaggcgctcgtgccaatggattatcattctggcaggcaatgcgttatatcgttttgccgcaagcctttcgatatgtcattccaccactgggcaaccaattcatcaacttggttaagaactcttcagtcttagcctttgttgccggattcgatttgatgtatcaaggtaacgttattgcgtctgactccctgcaaagtatgagcacatatctgtgtgttggtgttctatatctgattttgactttgcctttgagttactatatgcgttaccttgaaaagaaattggcataaaggaggaatcgagatatgttaacagtcttaggtgcttattcatggattaacatcaggttccttcttgaaggagcttgggtcacgatcctggtttcagtttgttcgattatcctgagttacatatttggggtaatcttgggaattatcagatatgttgaaattaaatatttatcagcgattgtcggttttgtgattgatattatccgtaacttaccgctaatcctgattatcttctttacctattttggcttaccaaatatcggcttcaagccggatccaatttgggcgtcagtcatcgccatggcggtctttgaatcggcgatggtggccgaaattgtccgtgccggaattgtctcaattccagtcggacaaatggaaggggccagatcgacggggatgtcttattggcaggcattgaggtacattatcttgccgcaagccatcaagaacatgattccagcgattgtgagtcaattcatttccttggtgaaggatacgtcattggcaactatcattgtgctgccggatttgatgaaccatgcacaaatcatttacggccaaaacaccaattatacaattccaatgttcttggcgttagccgtcatgtacttcatcgtatgttactcactgtcacttctgtcacagtacctcgaccacagactgggaacagccaagaagtcgggtgaagtggaggaagttgtccagggagcagaacggtagagtgtggattggagcgcttagcaaccggagtataagttaacgtctgttaaaatcgagtttgattttgacagacgtttacttgtacgcaggttgctgctccaaggaacacgttttatccaagtagaagcaacactactcaaagaaccccaccaaaagaaggccactcaatggaaataatcaaatttgcccgttttatggggccaatcatattacttctaatctttgcattcttagtgggattttcactaggattgtaacagtaaatacgagtcatcaacaaaaatcgttgatggctcttttcgtatgaaggtgtcactcttaatccagtacttcatcctccgtgcatcgatcaaatcactcatctgggtcgtcggaacacgtttgatctatgtaaaggtgaggctccaactaatgttcaccacaaaataaacccaccaaataacagtgaacatattaatcaaaataaatgtagttcaaaaaggagtaactcaagtttgaatttgatgccagttcttgcggtctaaacttcggccacaagaatggtcatcgcccgaaacataaaagattattagcgttctttgctaataatcatccttaatgtggagtagtagctacggtaactaaacgattccaaacccgaatcattcagttacctaggctatgctcagaagctaatcgctccttttagcactcttttttattcaaacacaaactgattatgatacagttccgcataaaatcccttttcatccagcaattgctcgtgactaccctcttcaatcaccttaccatccttcaacaccacaatcttattggcattcaaaatagtcttcaatcgatgcgcaatcacaaaactcgttcttccctgaatcacattatccatcgccttttgaatcttcgcctccgtcaccgtatccacatttgacgtcgcctcatccaaaatcaacaacgtcggattcgtcaaaatcgttctcgcaatactaatcaactgcttctgtcccgttgaaaacaccgaattttcatccgaaacctttgtctcatatcccttttccagactcataatgaaatcgtgaatatctgcctgtttcgcagccgcatacacctcttcatccgttgcctccggttttccgaaactaatattatctcgaatcgttcccgaaaaaatcacactatcctgcaacacaattcccacatgatctcgcaaacttttcagatcaatatcacgcacatccacaccatcaaacgtgaccgagccttcattcacatcgtaaaaacgattcaacaaattcataatcgtcgtttttccagagccagttgggcccaccaacgcaaccatatgtcctttttcaacattcattgacacatcatgcaaaatctctttaccctcattgtaaccaaagtgtacgtttttcaatgccactccgtgttccaatccagacagccgcttaccatctttcggattaatctcatctggttcgtcaaaggtctcgttaagtcgtttagcacccgtaatagccacctgaaacatactatagagtgaagaaatttgtgaaattggttgataaaattgttgtgaatactgcacgaaaacaacaaccaatcctaaagccgtcgtgcgcgccatatcgccatttagcgctaaccaacctccaaagaagatcacaattgccgtattcactagcgacaagccattcattactggaaacaacatccccgaataaacttggcctttaaacgtggccttacgaactttttcgttatgtggtagaaatcccttaatggcttcatcttgcaaaccatttgtaatcacaattttttgaccactaatttgttcgttaatataaccgtttaattttccaacttcatcctgctgaatatcaacatacttacgcgttttagaaatcagaatgaccgcaataataatggcaatcggcgttgatgcaatggtcacccacgccaaagaaatattttcgtgaaacatcataatgataattccaatcatcatcgcgatattcatcataatttcgcctaatgcttgattcagcgcgtttgaaatattatccaaatcacttgtgaatcgactcaaaatatcgccatcctgatgcgaatcaaaaaacttaatcgtcatacgttgcagtttgccgaacaatccccgacgcatccggttcgtagagtttcctgaaatataagtcaccacaatgttggaaataaacatccccaccactgtcaaaacatagaaaagaagtaacatccaaattgcctgcataaacgagcctttatcactcaccccacgcgtcaagccaatgacatactttgccaactctgtgattgctttccccatataaacaggcgccttcacctgaaaataagttgaggcaataatcgctaacattgtcacagtaaacccgatcttatagcgtttcatatagtgataaaagaatttaattgctttcccgatttcactcatttagatggcctcctttcccttttgcgttgcataaatttcttggtaaatccgattatttttaactagttgtgcatgcgtgccttcaccaaccaatttgccatcatccataacaaaaattcgatctgcatgcagcactgacgcaattttttccgcaataataaaagtggtggttccttttaattcgtgatctaaagcttcttgaaccaatttttcagattgggcgtctagcgcagaagtcgaatcatccataatcaaaactttgggttgcccaatgacgccccgtgtaatggataaacgctgtttttgaccacctgaaaagttggctgaccgttcttccactgaagcgtcgtaacgttctggtaaccgatcaataaactcggcagcctgtgcaatccgactggcccgatccatatccttttcggacgcatcacttttaccttgctttaagttatccccaatcgttcctgaaaataaaatggctcgttgcaaaacaaaagcgactgatttgcgtagtgaacgttcatttacctgcttcaaatcaacgccaccaactttaaccactccggtttgcgggtcaaacaaacgcgggatcatctgcgctaaagtagactttccggatccagtagcgcccacaattccgaccatttcgcctgcttttaccttaaaattaatatcctttaaagttggcgtttcatcacccgcataggcaaatgacacgttttcaaactcaacagaaccatccaactcctgctctgttgagtttgaatacgtaatctctggcgccgtatccagcacttcacgaattcgttgtagtgaaaccattgctcgggcgctaaaggtcatcatcatgccgccaataataatggcaaacataacctgcattaaatagttcacaaacgaagcaattgcggccacactaccgggatcactcttagccaaatcgcccacaaaataaattgcggctacaactgctaagtttccaactaaggtaaatgccggaatcaaaactgaaaacaaggttccaacaaaaatattttgctcatttaacttgtctgaaacctcattaaaacgatctttttcatttttttcttgattaaacgattttactacccgcactccaatcaggttttcctttgccaattcattgacacggtcaattaagccctgcatcagaccaaaatggcgacccatctggccaaacgtggccgctgaaataccaaacacgagaatgaccaacaccagaataatccaccacaattgatggattgtgttgatcgccaaaataaacgcccccacaaacagaatcggcacccgtagcagggtttgcagcgccgtcataattaaattctggatttgattgacgtcatttgttaagcgcactactaaattgccggcctgaaacttttcaatatttccaaatgaaaaagtttcaatttttcggaaaacagtttcccgaatatccgcactcattgactgcgcgactttagcggagagaatggtgttcaaaatacccgcaactaagccaatcacggcaatcacaattaaataaatccccaacgtttcgattttatgattctgattttttaaaatggcattaatcacattttgtaataacttaggctgccaaagggttgatcctgccattacaacgacagtcaccatggccaacaaaatatctccccagtattttcgtgcgtgatcttttaaaattttcaaatactttcctccgttctgacatccatgctattatgataactatactaatttatccaacactgttggataaatcaactaaaaaaacaccaattttgaaaaagcttgttgtccctctggaaaaacaagatattatttcaaattagtgtttaaatagttttaaaaaacagaactaaggaagtttaaatcatgccgaaatcaaaaatctcacgtccccaaattattcaagtttcactaaaaactttagcgaattgccaatcactagaccagttttccatgcgcaaggtcgccacaaccttacagattgatgcttccacaatctattggtatttcgaaagtaaacaagcaattttacaagctatggctgatgaaattgccgctcaaatttcgtttcctgatgccaacttagattggaaaactcaacttacccaattgtttaacaatttgttcgatgtctacacaacgcatccccataccgccgagctcatgatcgaaactatcccgtcatctgaagtgcgtttagccttaatgaatcacattattggaattttagtcgatgccggatttagtgaaacccaaggcagtgccgcgatgtccacaattgatttctttttaactggtttagtgatcgacctttcaaaagaacgccaatttcgcactgagatcaacgacaaacagactgcctacttgcatgaacaggtaacgcaaattcatcaaattacccatgatgaacacttagtgcacatgcaaaactctgttaaaagtcgaaattctgagtcggcaaaacaacaatttgaagctggcttgaagttaattttgaaaggcttggttgcagataaagaaggctaatcttgaacttcagcaaactcgctaacacctacaaactgctcggcaacatctttcaaatagttaatactattcaaatactgagcgatatcgacatattcgtcataaccgtgagaggaattattccccggacccacgagaataattggaaattgtttcttggcttggacaaactcggacccgtcgttagcacccgaagaactttcaacaggcaggatctggtcgaagtactgttcactaattttttgagcgagtttagttaagagattttcaccattaataatagggacttctggataaatgaattcaatctttaacttcattttaggatcactcgtgttcaaatcatccacaatcttttgcaggtccgtaaaaatttgatcatttgaatattccggaatagaacgaatattgccttttaacatggcatagtccgggacactattaacctgtttgccaccatcaataatatcaatactgtgggtcatcttgcctagtttaggattcacttcattatgctgtgccatcaatttcttggctgctaagtaaaactgaatcaaattatcaatcgcgttaatccccatatcgggacgcgaactatgagcaggcgcaccaattgaagtaacttgataatcaatcacacctttacaactcgtgataatgccgtccatatgtggttcagtgataatcaaaccatccaaatcatccgcataccctgcttgtgtcaacacatgggccccgtactcaccagtttcttcaccaaccgtggccaacaatttgagttgaccttcaattgcagttccactttccaacaattccagcataataattacagcggctgccaagccactcttcatatcagaagccccacggccaaataattttcctgcctcagcgtcaacatccccagaaaatgggccatgttgccactcttccacattgccaggatccaccacatccatatgaccgctaaagccaaggtgtttgccggttttgttccccatcgtaaccactaaatttgttcgtccttcagcaaaaggcacctttttaatttgaacttgatcgctatagggttcaaataatgagctgatatagtcagcaaccctttcttcgtgatcatttacagattcaatttgaatcaagttttgtaagatagtaattttttcgttatcagtcataagcaatttctccctttattttacggatgcgtattgatataacgcttttccagcttggtttgaataggtaagtcctttgacattcttgctaactaaatgcgtagctgtcgattgataaagtggcacaatcccttgtttagccatcaagtacttatcagcttcttgcatcaatgcccaacgttcactcgttgtatgattattagtgtcatcaatttcactcattaacttggtgtaatgtttgtcagcccatttagtgaagttcactggatcttgaccattaccaagttggaggaattcttcaggatcttgataatcgcccgtccaaccatctaggttaatatcataatcgccatttgacgcaacaccaatatgttgggaatgaggcattggcttaatttcaatggttagccccttcaagtatttagacgcttggccttgaatgtattgccccacttgttgatcagttgaggtgttatcaactaacattgttaaagtcattttctttttgcccaactgcttttgagcgagtttccaatctttttgcgcttctgcaacgttgaaggagagtaagttacccacttcacttgcgaaatctttaccattcttagcatccgtagaatccccttttggcaccatattaagtgctggaacggaaccatctgccaaaactttagaagtcatcgtttttcgatttaggattaagctaattgctttggataagttctcattactggttgccttacgtttgtaattgaattcgagaaacgccattcgcgaaattaactgtgtgctcagatttttagtattggcaaactgactcacggtttgtcccgaaatcgctgtttcttgaactttgttacctttaaacaagttaacggccgtggtgtcatccttaacaacctggacgttcactttacttaatttaacttgtttggcgttccagtaataaggattcttaacatatgaccaagtatccctagtggcattccaaccaaccaatttataggcgccactggaaacgactttagttgatgatgtcccataattagaaccatattttttaacatacgaactataaactggatacaacgatgttgctaaaacagtctttagatatggctctggttttgagagctgaatttgaagtgtatgtttattcaatgctttgactcctaaagcagaaggtttcagtttgccatcttgaacggcttgataatttttgacatatgtcagtaagttagccacttgagatttagtgtcaggatctacttggcgctgaaatgaagttgcaaagtcttgcgctgtaatcgccttaccgtttgaccatttcgcgttcttcttaattttaaaggtgtaagtttttccaccattcgttggtgtgacaaccttcgtcgcaatgcccgcgacaactttttgattcttatcgagtttgtataaaccttcgtccgtttgtgcaaacaaactaccactatttgtgtcaccgcctttattcggatcggccgtcgctggattaccagctagtgtgacattaatcgtttccgtatcactgtctgccttacttgatgaacagcccgcaaataaaatccctgaaaataaaattgcccctaatgctaaaaatttatttttcatatcgttaccccttaatggtatttatattcatattttcttttatttaaagaataaatattcaataactgtatattagcatcttctcataaaaagtcaacgcatttttaattatttatacaaaaaaatccataaataacgatttttactcatcatttatggatatacgcagttatttattcaattttaaatttacttgatagttataaaggaaactttcttcaaaagctatttttgtttttactgttttcccatagttcacaataagagcgtggaaattttgccatttttcaagatcaaaagtaacttgagcttctattaacgcttgggcttgttgatattgactaggcaatttacatcccagccacccaaacaaccgccgtgaataggcatcaaccataaaattgggcttatccaaaacgtacattaaaatgtaatcagcagtttcattaccaattcctttcagacttagtaattcatggcgcaaatctgcttgatgataagtttttattttggcaagatcgaattgatagttttcgagccagtggcagatattaaaaatagtttgtgttttgcgtgtatagaatccgctggtacgaattaaatctgtgagttcttctaaacttaaatgttcaatcttttctggatcaaaattagttgctgttttgagtttcaatagacttggtgccacatttttccaattggtattttgtacgagaattgacccataaataacttcccaaggcgactcggcccaatcagtgccatcttgcagccaaacttgtggacccatgttggtttccataatattgtataactcatttaaagtaatttttgttgctttcatcggcgattttgccaccaattataaagatatccgcccaccacaatgatgatcagcacaatgatttttgctgtcgttcgtggaaacggaatgtggttaagtccgagtactaaattagaaaataatatcatatgatcgctccattcttcactgtttatattcttataaagtcctgaagaaagcaaataaaagtgctgaatagtgtgattaaatttcgtatagtagctttttaaagcatagactatattcatttatgaaatcgttttaatttgctttaacttgccactaatgaagtccaaatcaatttgagttagaatggccttaacaaatttatatataaagggagtttttacattgatggaaaaagcttgtaccacagttttagtcggcaaaaatgcttccattgacggttcaaccatggttgcccgtaatgacgacacatttttaccaattgcaccccaccgtttctatatgcatcccgcagaaagtgatgtaaacgaaacaatcacttcgtcacaaaacggctttactgctaaattaccaaataacggctaccgccatagtgcggttccaaatatcaaccctgctaaagacggaatttacgacgaaagtggctttaacgaaaaaaatgtcgctatgagtgctactgaaagtgtctacggcaatcctaagagtctcgcttatgatcctttgattcccggcggattagctgaagacagcatgccaacaatggttttaccatatattgactctgctaaagatggtgtttcttatttaggtaaattaattgccaaatacggttcacctgaaggcaacggtgttatttttagtgataagaatgacgtgtggtacatggaaatcgttaccggccatcactgggttgctcaacgcattcccgatgatgcttatgcagttgctgcaaaccaggttgccatccaacagattgacttcaatgatcctgacaactttatgtggtcagaaggtatccaagaatttgtcgagactaatcatttgaaccctgataaaactggttggaatttccgtcacatttttggcacttctactgaaaaagaccgtcactacaacacaccccgtgtttggtttggtcaacattacttgaatccagagatcgaacaggatccacaatcaagtgagttacctttcatttgccatacagaacacaaaatttctgttgaagatgtcggttacgttttgagctctcattacaacgagactccttacgatccatttggtcatgctgacgataaagatcgtttgaagttccgtccaatttcaatgaaccggactcaaaactcacacgttttgcaaattcgtaacaacgtgcctgatgagctttccgctattttctggttaaacttcggtgtgcctgcattcagtccatacgtgccattctacaacaatgctactgacacagacccaagttacagcaacacttccgaaacaatgaatttggatgatgcttactggatgtaccgagccctctcatctgttgtggaaggtcactacagcaaatttattcaagaagatatcgattatttaaccgcctcacaagaacaattacgggcacgggttgctgaaatcgacaagaaggctgctgattattcagacgataacttaactgaatacttaacagacgccaaccacgaaactgtggcagctatgaagaaacgaacaatgaccttgttctatcacttgttaactgaaggtttaaccctttcaaaattaacatttaatatggataaaaacctttaaaaatagcctaataacaatgaaacagcttggaactccaatgttccgagcttttttgttcgtatgtgaaaatgcactatactgcattttcataacaaaacggactcaaaatgcattacgttgcattttagtgacgattttcacaaataaggcagtatcctgcattttacctaaagaattctcttcaaaaatccgcaaacaaaaaatcaagccgttctctacacgagattgacttgatttttaaatatgtgtttatctatttttcaacgtgcgcccacttataatcataaggagcaccagttggatggtagacaattcctttaactttggtgtttacaagctgagtttgaacagcttgataaagtgggacaacggcttcttgctgcatcaggagtttttctgccttaacgaagtcttcgtaacgtttctgttcgttatttgcatcttttccattagttgctgcaacgagtttgtcatatgtcttgcttgagaaaccaccatagttatatgtgttgccagttgtttcaagctgtgcaaaggtcaatgggtctgtgtaatcaccgatccaacgaacaacggccatatcaaatttaccgctaagctctgcactctgtgcacccttggcaggcaaggaacgcactgtaactgtcgcacctggcaagctttgctcaactgcgctttgaacggcttcagcaactttcttttgtgaatcgtcgtcactaaccactaattcaaagttaactttagattttccggtctgtttgagaccctttgcccagtacttcttggctttggcaacgttgtgttccacagcctctgaaacgctggcatccttggtaaagtctgtaccagtcttgggattcttcacaaaactggttggcataaagccggttgctggtgtcgatccatctgccaaaacttttgaagtcaaagtctttcggttgattactaacgaaacagccttacggacattaacattggcagttgctttgcctttcttgaaactcatcgccaagtaagcagtttgcccctgttcatacttcacaaacgctttattagttttttcttggctagcttgttcaccagaaagcaatgcatcagacagtttgccagcttgatacaggttcaaagcagtgttcggatctttaaccactttaacggggattttgcttacagcaacgttctttttatcccagtactgcgtgttcttgacaagtttccaactcatgttagttccgttccagccgaccatcttaaacggaccactgtaaaccatgtacttgctggaagtaccgtatttagtgccatacttttcaacagccttttgatcctgtgggaagaatgtcccaaatgccattaagtacttaaagtatggtgtagcttgggttaacgtaacttggacagttcgtttgccaatcgccttaatgcccagtttgcttggcttcatcttgccagctgaaattgctgacgcattcttcacgttttccatgatgtaggcatatccagccttcgtatcaggatcggccgttcgtcgccaagaataaacaaaatcttttgcagttaaagcatccccgttactccatttcaaaccttttcggagtgtgaatgtgtatgttttcccattgtttgtgggtttgacaactttttctgctaatcctgcaacgaccttgttacctttcgcaactcgatacaaaccttcttcagtattattaatcatattgaaagaagttaaatcgattgcttttgagccatcaatagttgttaagtccgattgctccataacactaaaactctgatgtttggcttcggaactctttgcgctcccgcaacctgccaataatactgataaaagaagtgtcgccgtgcctagctttttccacttatttttcatactcacatccccttaaaaaagtatattttttatccatacaattcgctctcttttttctcaataaataaaaaaatgcccgctatacttctttacgaagcacagcgagcaacctaattatcctcttatgacgatactaaaaaattattagctaaggattgaagtcgcagaaccgtgcgctttaattaataagctaataatgactaaattacttaaaattgctttaacaaaactggtcatgtgacttcacccctttcgacttgatgatgcttattataggagttgtaaattaaaagtcaacatattttttaatttagttttaatgaagcaactccgaccatgcatgtacgcctaaacttttttaacatccgctcctgtatagtagcttccattaggacgattaatcccaaaactgaccaaatttatccacgagcaaggtaaaaaagtcccactccgtttgttttggcgaactggctaaaggtaaaagcgctgtttcgattaataaggcatctttcctgacacttggtgaataacgacccacatggtaccagtaacgattgttatgtgtaaatccttgcagttgattcacaatcaatagacctatcgtggtcgagtgaaccgccaatttacctaataaatagtaggctaacggattgtcagccacaattgctgtaaggtccataaaagtaatctttttctcagctggagccttggctagaaatgaatcctcataacatttttcacctaactcagtatgtttggcttctaattctaagagcattgggtcaacaattgcatccaaactaaccacttgtttttttgtgggttctagccagtattcacacaaaagtttggaattccaatttacaattttccaatctggtttttgcgtttcaactaattgatctagatgagttagtaccctttcgttattgccgttccacacatcaaaacgagtgctagaatcatctgtatcatgattgtcagccccttgtttttcctgcagttcttcattaagttgctttatattctccgtaaacgcaggatcactagtttggatatcaagttctacactggtttcaatggtaactgccgccataaactgttgttccaattcacttaaattttgagtagttacccatttcacaattaaatataagctgacactttttaacacaaagctggcgtcaaaataggcatgtctgtattttaaaaataaatacgcttgatgccattgcgcttgcgttaaatttgggaaatcggtttgaatcaagcgcatgatttctcgacgccctcttaaactgccatgatccggaatcaaatcaacttgaaaatcttttttgaaaaaattttcaacaacattgttcatggctatcgttaagtcaggtttgttttcaacttttgtcataaatatggagggatcacccttgaaccgtgtttgtcttcgtgtcatgaaaagtttcctcatttctttttgactgtgttcatttacttttttatgtagccaaccatcataccacttatgtgtgcgcttaaacacataattagtcatttcattcgaaatttatcttgcacttagctaaatacgccaaaatcatatttttaatttaaaatactcaaaaatcactaacagacaatgcttcactccaattaacgttgcattctgtttcaaacatccaatgttttattcaaattatgcgcacaaaaaaagtagcatccgcaaagacactaccatcattcttttaacataacgtcattttattctcaatgccgtttctagccattatagaattcgtcaaccctttgttccattaaccaatccgggacattggcaatttgcgcggcagtatggccgatgatgttcaaccgggcatacggaaatagtgccccagcgttgcgttccccaacctcattaaggagatcctgattataggtagttgcgaagtcaatatctctttccaacaaatcattaggtaacaacaacttagcagctattttttcatcagtccatttgtttaaggcaccttgattttgcgagaagtcgggcacatattcagcgtcaccaagaatatagtttgccatgccttttgctgcataccaagctttatcctggatactggcatggcgcgcggaaacgatgagcacatcgatatcactttttttcgtgcgatataacttaaagtcagttcgcagttcactactatagtctaatcgaagccccagcgatgatgccaaatctatcaaattaacagccgtaaatcgatttccttgaatatagtgaccaatatagtctgccataatcggaaagtcacggataatttcccaatacatatactttccatattcaggttccaatttctgatgatttgaagcaggttcctcgtcttgttcattttccagatcatcgttttggatcaatttatcttcactcatcgcaattatctccttagattgatgtggcttggcttgacaacatcattatgttatcactgtactgtgccataatatggcaatctgagatgagaaagaaaaaaagatttgataatttttgattcacacaaatttattttaaaaatatctgttttctattgaaaaagatcaaattattttagttatatatcttcatcgccaaattatgtcgttggcattatgtataataaccgcgtactgtaaatagagcttcacttagtaccacacatttgctgataacatcaagaaaggagaaagacatgccttgcacaggcatgagaaaactaaagtaacaaacttggttacatattaatttacgagctctatcataacattcaaaaaaaactaaattagcgatttgattggaggatacaaaatatgaaaacaaatgctgaaatagctaaagaaatagataatattcaagtaactttaggcaatgatgaaggtagaaaaccacacatgcatgaaatttcttcctttctaacttataagaaagtcactgtggacgataagttgttaacttctgcacggctcctttctgattttccgaaggatgatttggtgccaacaccaacaaatcttttaacacattacaagttgaaagtaacggatctagattttgatgaatcctttacagactttagtgaggaaaaaggaaaatcagaatttaataacagcgcaatgtttatcggacttaatatttctaatactgcaaattctcaagagctagcagatcaaaaagatgattggtatatgtttcacacagatgaaacaattaaaaaaaagaacagcaaatcacctaaattggacagcaacatggtgtacaactttgttgaatcccactttgataacagttttgatggctgttacataacggatattatcaaagatactatcgacagtaatagtgccaacataaaacaaaatttcttcatatccactcctagtagaagaaaaaaagaatacatgtccagtaacgactggaaagtgctaagtgaagctgaaaaattagaatatatatcatcaaagataggtagatataatttgatgcattcaaatattacaaaaatggcagagacattatttaagactgatcaaaacaaaaaagcatcgaagaaaaataattcaggccatttcgattcattagaagaagccgaatctcaagttaaaaagaatcgagctaaatttatcgaatgtgctaatatatttattcaagaatgcaatattattaagccaaaacatttagtcgtttatggtgaggatactgagtgggcattgcttagaatgttagatattgatgcggtacgacaaaacagaaaaattgttgatcttattgaaaaccacattgaaattaaacattattctggcgtatatagcatcgcaaatgcaattaaagaaggccagcggttattacatgctgttaaccataatcaatcggcaatagcattttaacttaaccatctcgataaataaaaggaagccatcaatcaattttgattatggcttccttttgttatttgatcaatttttagtacctaaacaaaactaactttgttacttaaacattctatccgccagttcatacgaaatccgaattccatcaacaaaatccttcttcgtcatgttttcattgggcgcatgattatgctgatcgtaattagcgtatgggatggttactaccggcactttgagaatatcggtccaaacataattaggcacagttcccgccatgacaggttccacaacaacagatccagttgcttgttccacaattgacgtaaaagtggcgatcagacttttagataaatcagaagtgctcggcggaatcgaacctaggtagtttattgaaacttccttattttgtatttcattcgcaagaacatcctcaaggccctttttaagggtttcaatatcttgatgaccaactagacgacaatcaattttaacggtggcttgatgcggaataatggttttaaggccctttcctgtatatccgctctcaatgcccgcaatattaaacgttggtcgatacattaagcgttcgtaaaactcaattttatcaggaattgtgctcaatccgagttgcgcacaaatttgtttcttatcgtatggtagcttgtccaataaatctaacttaatttcactttttgtcggaacaccctgatagaaattaggaatcagaacctttttcgtatcaaaatcatacaacttcctcaatacttcaatgagtttaattgcagcactcgtcataatattaccggcattacctgaatgattatcattctgaccggtatgcgcagtcagttcaaacccaaacaacccgcgattccctaatcggaccacgtgctcgccatcttgattgatcgatccatcaaccactaccgccaactccacctgtttcagtaatgagtcccgcagttttgcaactgttgaccctaagttcacactgccacgttcttcttcaccttccaccaaaaatgtgatgttgaacggcaactcaccatggagttgcttgtaggtatagatgcctagaatctgagccatcaactgtcctttgttatcaccaacaccacggccaaaatatctaccgtctttcaaaatcagtttaaacggatccgtatcccacaaactgcggtcaccgccaggcatcgtatcataatgaccataaaggagcaccgttcgatcagtcgtccctttgatttgggcaacgagcgatggtaatccggctgtttcaatgacacttacttgggcgtccagtaatctttcaaaaattcgttttaagaaattaatacaatttgtcatgtcgtcatcttcattacttaccgatcgcgtttccacaaattcagtcaacaatttttcaaattccgaataatggcgatctataaattcgatttcttcactcattgtggttcctctcgctttcaaatactaatcctactgactaccatattagtctttttaatctggaatgtgtcactcatatttattctctaactattaaaatcaagtaacctcaaaaaaagcattggctcagcaccaatgcttttctcaatcaatatcgtcaatatgaggaacgttaatctttcgttgttttacagacacttcataaaaaatccaagcaaccagcgcgaagaaaatcggtccaataactgtccaaaatgcggtgtaataatcatgaattgaaagtggctcaattaccgtaaatataattcccaacaaaattaccagccacgtcacaatcgttattgtccacgtcatagcctttgttttgaagaaaacaaagggtcgctctaagcccgtgcgttttttaaagaacggaaaagcgccgactaaaaacaagtacggcacagccgaggaaatgttttccatatcctgcaaaaccgtgtaaaaggactgtgcattgctacccccaaaggaaacggcaaacacaatcaccgccacaataatagcttgaagccacatcgaatacgcaggaacgccaaacttatttaatttggtcatttttttgggccaaaatttagccggcgagcccataatgaaggattttaaaggtgaataaaccaaaacgaaaaacgcacccatatcggacaagaactcttcaataccaataacccgcgcaaaccagtttcccaaattaacactggcggctactgataaatgtaaagttttcccaattgacacacctaagttattcattaaaacatataacacgttgcctaaatcactcgttttattaccaagaacgacgtgccagtttgcactcacaccccacagaaagatgcctagggaataaactatcaacataataatggtcgaaatgatcatcgcgcgtggaaaggttttggatgaatttttcacattatccacaactccacccatagtttccatgccaccataggcgaaaattgcgtatacaataaacgacataattgcaattggcgaaccaaattgcccgtttggtgaatgaataatggaccgtgccgtaaatggttctgctaaatgtccactttgaacagccaataaaactaaactaatcagtaaaaatagcgcggtgatggttaacgtaataattccgccaaacgctgcaaatcgcgcaatctgattaattccatgcgttgagaaaaatgtcacggcaaacataaacataatcgcgataagaccgatcgtttccacactattcaatcctaaaaagtgccaagattgggtcgtgtcatatcctgtgaacattgtcgcaaacggaatccagatcttggatgattccgaaaccaaccaaacgatccacccggataaccaaatgaacgtcccaataaatgccagttcttctccaattgaacctgccaaccacgaataaattccaccatgggcttctttaaaactagcgccatattcggcaaacatcattacactaggaagaaaaaataaaattgcccccaaaacgtaccacagaatggcgccataccccatttgatcgtatgcaaccgtagtatttgaaattccataaatggaggtaaacaccataagaattaagccaaccagcccaattttatgctgctttgtgttctccaactcttccaaaacaaatccttctctctaaaatagaaatacttgactattttagcacttttttctgtaatatatgcagtttttcaaataacaatcactaatttaagcttttattcattatttaatgaataaatacacaattttattcaaaatttactttttcaatgttcatgaatacgttttacaacagtaccaaaagtcttttctttttctaacactagatcgtataatgaagaactaagaacgtttcttaagttactgttcttggtgaattttaacacactgaatttgaatcaagaatcttctcataaaaacacgacaacgttatataaaaacatttgaaaatcaccttaataaggtgaaaagtcagttataatcaggttatcagctctagtttaggaggtgcactagtactcatgaaacgacgaggttcccgctccaacaatacacatcgtagaaaaataattcttaaatttacactttggctatcaattgcgttgctgtttgttgccacaatggcctttgtttatattcgtcatgtaaactccgaaccaccagctaataatctaaccttgagtgccgctagctcccgaaaagaaaaacgtgccgaatccgcatcaattgccaagtttgaatctagccttagtgctaaagacagatctaacgctcagtcttcctcaattttccgtgctcgtagttccatcagtaaagctaaagaatcgttagcacgtgaaaaagcagccaacagaaaaatggctgcttcgttgaaacgtgcacaggcaaaatccgctaaagatgctagttcggtggcaagagctgccaaacaaaactcaacgaatgcagaaaaagtttccagcgaatctgccaaagcaagttctaacccacaaagtaaggctagttcaagttcaaaacctagtagtagttccagtagccaatcaaaaagttcttcggtgcaaactagttcacaggattaatatattttaaattgaaatcaaataagaaattaaatattcattttaacaaaaaaagcatggtaagctgtagtagttttgccatactttttaaacactcattcattttactgccagtgacacctactatttttggtgctcattcatttccactaagtctttaacgatatcaaacattaaaattatcggaccaagcaaagcatatccaattctaataaagaagttgaccgtcatatcaaaattagtatcccacaatgccagtctttgggtgcttaaattgtgttgcacatttgcataactgttatctccccatttgtcttttctatgatattttgcatgttcctgttgggtaattctggcaccaagttgtaaaaacgataggttgcttaatgaccaaatttttctttttactatataaaactgacagatccatgacaaaaaaagccaaatgttgtagaaattaagtcttacattgagatgatttgtattgtcaatattgaaaaaagcaattaaaaacaacatgattatcgattgctcaataactttatgtatgtatgatttgttttgcataggctgactccttacagtgtttaagtagtacaaacaattagaaaatggttagtaatttaattcttatttaaccattataattaaaaattctcttaagtaaactgtaattatcatttttgccggaaaatgttcttcaattttagttaaaaaacaaaaaaatacaggttttcacctgtattaaagtacctctatattaatgatgcgtcaggggggaatcgaacccccatcatgaggaccgaaatctcatgtgctatccattacactaccgacgcctatagtgtaattctaatgaacttgagttcaaatttcaacctaaaattttggcatcaactatttggtgatagcacattcctccggccacttcatttattaagtttttttctactgagcaagttgttgtccacccttgtgtggccgttgcatccccttcaataaccgtaaccactgatttgtgatttttttcaactcaaaatctcgtgctcgcttcaatgataacttggcatacttttgtcgttcttccacactatctaataatggtttgatggcctgataaaaatctggcaagcaatgattagacaacaatactccatatttaccatttgccaaatattcttcagcaccagtattgtacatcgaaacaactggtaaaccataactcattgcctctccaatcaccaatggtaatccttcccaacgtgaagtcattacaaaaatagatgaattttgataattttcggtcaactctcgattgtttaaatgtcctcgataaattattttatcagcaacgtcatgtttttgaattaattctttaaatttttccatgtcatctggtttcccaccacccgcgattgaaagcatccaattatctggcagatcttttgctaattctaacaacaaatcgatccccttttgttgaatatcaatccgtccagtaaagttaatcacatgattctccaaatttgctttaccagcagactttaaagtcaacggattatgaatcttgattgtctgggcgttgaattgcttgaatccttttaaatcatgttcagttagcgtcaccactaaatcagcagctcttaatccgctacaaaattcctttttcatttgcgcataataatcgttcagataagtatccgcattattatgcatccacgtaatcacccggacgtctggtactcgtcgtttaatttcaggtgtaaaactagttaacaatccggccgtaaatagggcaacatcgtaatcgccttcagctaaaactgttgctaaatctctaatttgttgtttaaacttctgcaatggcttttcaccacgaaaactcttgcctcctgaatctatagggtgctttgccacaattagtggcgcatttaaatcaaaataaggtttgatatcagccaacgtataatagttaatttcaacccgattcgccaattcattagctacgactgttgttgctcttttcaggccatccattaaataattttccgtacatactaaaattttcatcgacatccctcttcacctttttatttcacttactgactttgcttatgaaaatgagccatccatcaaccggacaacccgctaaatatattaaccgtacagtaacatggcctttgcttctttttcaaactttttgcttatcaattctataataaatatatgtgcttctgctcattatcaatattttattcgaaatctgaacaaattaaaggcaaaacccattgttctacacaaaaagcttcgcaccaaattctaaaattaatttggcacaaagcttttatttacacttttatagttaaagttgatctatcaaaacacgatcaatcatgtccaacacaccactatgattattatcaagtggtgtcacaagcgatgtcgcagccttcgcttccggagccgcatttttcatagcatacccatacttggcatcctgtaacattgcggcatcattttggttatcgccaaacgccattgtttctgccattgacacattccaaatgcgttgcagttgttccaatccatatgctttcgtgacgtgtggcttgataatatcgatgccgctgtagccgctcatcacttctgccaattgatcaccaaactcacccactagtgtagcgtgtttatcccgtacatccccaacaccaggccagttcacatcgactttataaatttcatcatctacatccgtcaaacgatcactgtgggtcaacatttcataaaaataccgtgtgcgaccccaagtttctgtcgagttcgtcacattagtatacgcacctttttgacctgacaacacaatcactccgttcgccaaaacgagcttgctggccatgcttgcaaccaccgactgccacaattctggctcaatcggactcgagtctagcacttggtcattttcaacaaccaacccgccgtcttcaaccacgtaggtcaaatccccattgatgccatccatcacgcgcaaacaatgttgatattgattaccactggaaacgacaaagtgaatacctcggtgattcatttcatccagttgttcttgaaaccgttggcgatcaaactcgtgctgatcatccaaaaacgtaccatcaatgtcactcgcaattaattttattgtcatctgaaactccttagcttatttaaaattttgaagctaactaacgctgattaatcacacgatgaatttccgtattcaaatagattaacatcttattagcgtcttgacgaaaatcggcatcaaatgaggccccttgagatttaatgtcaccaatcggtttttgaatgacatcaaaaattgtaattgtatcgtcgtttaacttgcaagaatagtaatgaccttctagttgttcgtctagtagagactgggcattatcctgaatcgcttcaaaaacaacttgcttctcgtcgcttttatgtcctaactcttctagttctgcaattttcacttttacatctgtcatattttgaggaatttgaatcattttagttcgctcttctttcatttgaatgcattaaaaataccccttcattctatcatgatcggggtattaattacgactatttatcttactaaagattgaaagtatcaaaattattatatcagtgtgttgcttgcaaagattagacttagtctggaagccactgggctcagtagtgtcgtttatcttatcggttttcgcttagataaagccgagcttggagacgtggcttacgaatccaagtcgtgcccactattccgcctagtaatgatttatgtatattttaatttacttaagtgttgatgagaagagtagcatttttaaactgataaagagagcttcgattggtgagagaagactggttaaaaatgtgaagatgatctctgaactccgaatcggtcaccaagttattttggtttggctaattcgacgtcagcaagcgttactttgccgagtatcccatccatcaagatggcgtacttaatgaggctgaggttgtgaaatctcagtgaagccaggtggtaaagtgaaatagccttcaccctgaacagcgttaacacgcatcgtttaggatgaaggcttttttggtgaaaaaatttaaaggagaatgagcatatgtctgacaaattaatcgatattgatacattacttgcacaagctggaaaccgggataaccacgatcagtaccactcggtttcaaccccgatttatctcacgtcaaactttcgtcaccgcgacttggaggatgcggagacctttgatccgcacaaacagtactcctactcacgcttatcaacgccgaccagaagcgtccttcaaaagaccctcgccgacctggaaggcggtgccaatgcatttgcggtcagttccggaatggcggccatccaactggtcttttcgttattcaagtctggggatgaaatcatcacctcagacgatttgtatggcggctcgtttcgttactttgattacctggcagaccactacggtgtcaaattcagtaaatggaacgggaaggattacgaaaagttaagtgacttggtgactgccaaaaccaaggcagtttggctggagacaccctccaaccccaccatgaaaataattgatattcaaaaagtggctgatctgattcatgcggccaatcagaacgccttggtctgcgtcgacaatacttttctaacgcctgtgtatcaacagccactccgtgagggggcagacattgtcgtccacagtgccaccaaatacctttcagggcataacgacatgttggccggctgtgtgattgccaagtcagaagaaattgccagtgaactggaattcaatttcaatacaaccggcgtcactttggacccctttgattcctggctactgttaagaagcctcaaaacgttggccgtgcgaatggaacgccacaccagcaacgctaaatatgtcgcagcgtgtttgaagaaattgcctcaagtccaaaaagtcctgtatcctggcgtcggtggcatgatcagcttttatctacaaaacatggaccaagttgaccggctgtttaaacacctcaaaattatttcatttgctgaaagcctgggtggtgtcgaaagtctgctgaccatcccttctcttcaaacgcacagcgacatggccaaagaagatcgcctaaagcttgggattactgatgaactcttacgactgtcgacaggattggagaacccaaaagatttggccaacgatttgacccaagccctgggtgattaagtcgcgtttcggactgatccgccacagtctggcacctcgataattaatattagtgagccataataaaaatcctcaccacttccagcaattggaatgatgaggatttttcattgttcagtttggttcatttgagcgatttttacataaaaattggcaaacgataactggtagtatggctgcagccacagcaacaaaatgccgtaggtgaacgagttgaggatgtaccagccaataaagctcaattccatgacaaagtaatccatcttgtggccgaccatcatttttcgactccgggtaattgcttccagatacccaatcggcttgccggcatccactgaatcccggtaaatgtttaaggcctgtgaataggcaaagcccttgataattccaggaacaatcaacagtacggaccataacagtgtcagtacagtcgtgataatgccaatcataatcgcgccgatgaagtattggccatgattcaagatagtaaacgacctggtcactggttggtcaaacggtactttgttgcgaattaggtcaatacagacaaacatcattccagacaagagaaggccggaaacgattgagatcaaagtcgaaatcagccacaaattcaacagttcattactgccaaagtgggcagttccctgaataatttgattaaaggcctggttggtatcaacctcgtgcaggggattggtcgaataagccactgagtatcccagctgaataatcactgccggcaggaacaataagataaaaaacggaaaatgactgccaattatacgcttggcttctaatttcattccaacacgatccataagtacctccaaaataattgatactgtctatttaaccataacttggaggcctgccgcaatgataccaccggttaatggaccaaacatcggtacccaggaataataccattcaccgctgccacgattgggaaccggaataacggaataggcaaatcgcgggccccaatcacgggcagggttcagcgcaaacccggtggtcgtcccaacgccaagaccaaccaccatgatcaataggccgacaactaacggtttcagcccctgggtaaaatctcccaggtttagcagcgcaaagacaaacacaaaggttgcgacaacttcggatagataattggaaaccggcgaatagatggctggtcgggtcgcaaatatgccaaccgtgttgccattatcaaccgttgtcgttctgaaatgtggataaaagatcatcatgatcgtcgcagccccaagaaatgcgccaagaaattggcccaataaatacggcaccacctgattccagggaaagagcccaaaaatagcataaggaatcgtgactgccggattcaaatggcccagtgaccccagtgacgaggccacatagacccccatcgttaccgccattccccaagccacactgataaacgtccagtttgagcctttggcgtaagtttgcttaaggttggcaccggcacaggcgccagtccccagcacaatcaacacgtacgttccaaatagctcaccgataaatccattcatattctcacccaccaaaatttttgtattcaatcacattttacaggttagtggagcgagatgaaagccctttcgaggtcaagtggttcaaccacaacaccagtccaagagcgacaacggcgtagaccgcgccacccgggccaaccgcgtcaaggctgaggttactgacaatcaccccaccagtcgctgatcccagggcaatcccgaagttggaaaaaatggaattcagagacgaagccaacacaattgactgtggataatccttttcagcaatttgcaagaagaacaactggatcggtgaattaatcagcggcatggtgaagatgaccagcgtcaaaagcagtgctcccggccaactgaagttgaagacaaatggcatcagcatcattaaaatgaactggccaatatagacaaacggcatccctttcatcccaggaccttcacttaagcggccactggcacggttaccaataatgttggcaattccaaagacggccagcaaaatggtcagcattgagactgaaaaatgcagttgattggtaataatgggccgaaggtaagtgtagaagacgtagattgcggccaggttaaacattggcagcagcataccgatttggatccggtgattgcccagcagtgccagctgcccggaaatggtactcttcttttgtttgaagtccttgggcaggctgacaaaaatgaggcccatcgtcaaaactgagatcacaatgaccgttagaaacgagatccgccagccaaactaggttgaaatccaggttccaagtggcacgccgacaaccgaggcgattgagaaaccggaaaatacccaagataacagccagccgcgtttagccattggcgctacataaccggcaaaggtcaagccaagtgagatcgacacgccggccaccatggcagtgaccactcgtgacaccgtcagcattaagaagttgggtgccaaaaagcttaaaatgttgccaaacgtgaagacagccattgcgaccatcaaatcccagaatagattgaatcttccaatcaggattgtaatgaacggcgtactaatggcatagacgatcgcaaatgccgtgaccagatacccaacagtcgcaaccgacacgttgaattggtgactcaagtcatccaggatcccgacaattaggaattcactgaaccccaatacaaatgcaataagaactaaaacgaagctttgaaacttgaatgttttcattgatttctcatcccctttattgatttctgaaaagcacaactttttcatactacaggttttggtagaaattatctagcgttttccagggaaaagttctgaggatgttggatttaatgtggttgtaatattctggtttgcatttggaggctgcctagcctactcggcgacgcccctgacccctgctacacaaaaagacagccaacgatgaacaaagttcgtacgtgatgtttggtgcatttgcatcgattttatagagcttgaggttcttctattatttcctgctcccttcggcctttgagctatgctccgacgcaactgatgctaacgtgtaaaggggcggtgattaaaatccaaaatcaggatttcaatcaccgcccctttacacaccgcatcacccgttgcttgtcgcacactacaaaaaaggaacccgcacactatttgcgagttcccttctcaaatgcatcaactattttaattcgttctccacagctgatgccttaagagatattccactattcaaaaagcatcacctccttttttgattggtaatagaatacaaccaatcaaaataaaatgcaagctgtttgaatcgtcagtcatcatagtcattttcatgatcgttctgcaggacatcatcgcctacccaatactgcttgccggactgattgcccaacgtaattcgatagaaatcctcatgatcgtactcgttatcatcgtcatctttgaaggttgcgatcgccttttgattgacgtgaaccttggtgttttccgaaacgtttaagttatcccacgagtaaactttgttcgaatcaacggttcccgggacattctgatacaaatattcttcacgatactcccggtcaagggaggttgtaaaattggccttttcatagcgaactttgactgcccgcttggcgtgagtaatcgtcgtcgaagtcgatgccgaattagtagttgaagaagtcgtcgagctggactgctctgtcttcgtgctgctggaactttcactgctcgaattatttgactgattcgaacagccaaacaatcccaacggcagaattaatagcagcaacccggtgatgaatgcttttttcatacgctggcctcctgacgaagtcgtttgttataatacctgtctttattataaatgatcaggtaacgaaattctaacaaaccgcttcgaagagaccgtctcatcagtctaaaacagtgtatgaatatttgtgttcatatttatggtttggaaacacatgataagtgccaatgccatgatatttgattaagactttcttgtaggatccgccaatcaacttcttagtggtcttgtactgacccaggtcttttttcgaagactttgatttattgaagaggtaccaagacccccatttgctgacctgaagcttacggtcatccttttttgaaggggtgtaagatttgccattggtggtgaaactgtgcgtggtaatcttgatgacattaaacttaccgctgccacgatattcgtaccaggtgccccgcaatgctttgggggtcgtggttgaagtgctggcatccgccttggctggaagagctgctaactgaattccgaaaacgattgccagtgcaaacataaaaattttgaattgtttcattattccgcctcccatgagttataacaagtatatcatcgattaccgaaaagttatttttccatccgactacaattactttacagaaaaagcctttgacataaaggttctgtcaaaggcaatagggcactggattggaaaactatttgtttgatcagtttgcatcgaatcaaccggctgatgactgtttttgtaaacaatgttacgaactcacgacaaccttttacactttaatcgtcaaagcggctttcaattgccctggcgtgggcttcgagaccttcaacccgtgccagagtcgtgatggcatccttttcatttttcagggcatccctagtataggaaacaaattgtgtccgtttaacaaaatcttgaactccgagcggcgagaagaaccgtgccgtgcccccggttggtaagatgtgattagggcctgcgaggtagtcgcccaggggctcggaagctgaaaatccaaggaagacggagccggcgtttttgatttggttcaagtattcaatggcatcgggtaattggacttccaaatgttccggggcaacggcattcatcagggtaaaggcatcgtcaatatcgtctacgacggcaatgaagccttcattatccatcgctgctttggcaatttcctttctgggcagtaaatcaacttggcgatccatctccttgctgacagcttcggccagtgaacggtcatcggtgactaaaattggtcgggccaatttgtcatgttctgcttgagacaataaatccgcagcaacctggctgggaaccgcctgggacccggcgatcacaccaatttctgagggaccggcaatcatgtcgatgtcgacctgaccaaacacctgctttttcgccgttgcgacaaacacgttaccgggtccggtaatcttatccacccgtggcaccgtttcagttccgtatgccaaactagcaatggcttgggcaccgccaaccgtataaatttcatcaaccccggcaattttagcagccgccaagaccgccttatttaacccgtccttttgtggtggcgtaaccatgacaattcttgaaaccccggcaatcttggctggaatgacgttcatcaaaatggaagacggataagctgccgtcccacctggaacgtagagcccaactgctgccagtggggcgattttttcaccgcgaataacgcctttctttttcgcatcaataaaactgtcttccacttccatttggtgaaatgacgtaatattagctttggcaagttccaaggctttaatcactgtgtcatcagtcgcttcataggcatcgtcaatttcctgttgggtgactttcaaactctccagctcgacattatcaaatttctgttcgtacattttcactgcctgatcaccatctttgatgacattggcgataatttcccgcactgatttttcaacttcttcacggttagcaaccgcgttggtcctgatggcaacctgtttcaataattggtctaaggaatcttcaataatttgcatataagccactctccatttcagataaccaaacattcattacaatcaaatcctatgaaataaaaaagtccccagacattgccgaagcaatatctgaggacgatctttcgcggttccacctcacgttcatcgttttcttacaaaaacgaccttacgctgctcgtaactagtcgtccaaattggagaacagttacagtagccgtggtaacgctcactagcgggatagcctacttggttcagctaaccagttcatagatgtgtgttcactgccactcacatccccttctcaccagcggggctctctttatgtgagttaagcaattacttttctaatcgtaacttcatgtttattatttatttttaatttgttgatacatgtaatttaccaccactgagaaataagtcaagcctaatttaataatctttaaatattaaagaaaatcgagagaaacatggtcagtgtgccgcccatcacgaagaagtgccagattaagtgcatccctggaactctgggaatgctgtaaatcaatgctcccacggtaaaagtcacgccgccggcaaccagcagccaaaaaccgctggtgctcaaattgtcatatagcgctttgcccaagaacatacataaccagcccatcaccacataaatggtggtttcagtcttttgaaatctgccatgaaagacaacgtggctgatgatcccaccaattgccaacacccagacactggccaacagaaggttgccagcccagttgtggacaaaaatgacacaataaggagtgtacgttccggcaatcaagatgaaaatattgctatgatccaggatctgaaagacgcgtttggctttggtaaaaacaaaacagtggagcaacgttgacgccaaatagagtgagagaactgtcgcactgtagatgatcaagctgacaattgcccccatcgaaagcccatcacgtaaagctttgttcactaataaaatggacaaccaaatcgccacaaaaaacgaaacaccgtgggtgacagcatttaatacctcatagataatttgttgatgacgccttttagccattaattcattcatcacgatgcctccttagcatcataataagctattctattttctaagtcaagataacatagttttaaagtctacgtactttatttttcgactatcctatgcaataatactagtattcaattcgaaggggaataccatgactaaagataattttaccaaaaaattagcggcgatgaccatgccgcactttgaagatttacctaatttggatttgtatatggatcaagtgattgacgaggtcaaccaatatttggcaccaatcacccacactgagattaccaaatccatgatcaacagttacgttaaaaaaggcctggttgaccgcccgaccaagaagcgctactcacgggttcacttggccaaaattctggtggtgagtctgctcaagccaattttatcgctggataccatcgaccaggcaatgaaaatcgccctcaaactcgactccgcccccaaagcttatgatcagttcattgacctgttcaatcaggagctgacagatgtggacgctgatcatttgtcagctaaacagtaccaatcaatggcaattaagtcactgctgtacaaattagtggtggatgatcttatccagacgagtaagcaggcataaaggacgttttactaagtgaattcaacaggttgcactataattaacttgtaaagatattttaaattgacgggggttgtgattatggatagaaaagcgttaaaactagactctaagagcctattaaatgctcattttaaatttttctttttgctatttttaccagtatttattcttgaatttgttggcggctatatctatgcgccaaaagaagagctttacgatattaacggtgaaccaatctggaccagtgcccagactttcggcatgattctaattctgctcgggtctctggtcgccattggcgtcgcctttatctgtatcgacgcgatgcgacaaaagttgacctatgatcagccgctgcaaaagtcgatgaccatcttcaacaacgttgactatttcttgggaaccattgtcatttacatcattgagcaggttttgattattctttggatgattctgttgatcattcctgggcttattaaagccgtcgcctactcccaggcattatacatctaccgcgatgccgttgaccggggcgaaaaaatcagttatttggatgccattacccgcagtcgtcaattaatggacggccataagtgggattactttgtaatggccctcagcttcattggctggggactgttggttggcattaccctggggattgcggccatctgggttcaaccttatatgcaactcagttttgccaatttctatcgcgagttggtggatgaacacgaagcgcaggtccatcaagaagccgatcgaatcaatgttacaccggcagccacttctggaaatcaacccacaaccaccaacgattcaagccatcaatccgacaatgaatccaatgacgattcggacgactcatcaaatcaataaccatctaaataaggttcggccttctctaactgagtggtcggaccttttattatctcaattaattctgtcacaatcagtttaaaagtgtaaacgtccgcatcagtcgcgcgttttggcaccaattaatatggtattatacagatacaagtaatgataacgattggagatttttgcgatgcgggtgacaacttttggagagatcatgttaaggctgacggttccggataatcagaagttggttcaggcgacttcgttcaatgccaattatggcggtgcggaagccaacgttgccgtttcactggctttgctgggggatcaagcggcctttatcaccaaactccccaacaacgaaatcggcgacaccgccatttcaaaactaaaggcgttcggcgtcgacaccagccgcattcgtcgcggcggcagccgaatcggtctgtattttctccagcaaggcgtcagtcaacgagccagtgacgtgatttatgatcgggcgaccagtgcctttgcaacatcagaagcggctgattatccgtggaatcaactactggatcagacggatgttttctatatttcggggatcaccgctgccctttcaactaacctacagatgattcttttatcagccgttaagttctgccgcaatcacgctatcaaagtgatttacgatgctaattttcgaggaaaactctggacgtctgatcaagcagttgcgtttaacccacaaattctgccgctcgtcgatgtttgtctggtccacgacgaagatatcgagcaggcctttggcatcaaagcctttcaatcggccaaccaccaagcgatcgatcaaaaggccacatttaagcaagcaatcacgaccctcgtggcgaagttccccaacatcacaaccgtggccagtatcttacggaacattcatagtccccaaagcagccaatggatgggaatcatgaattatcaaggtcaattctatgagagcccgatttacgatgtcgaagttctccctgaggttgctggtggtgacgcattcggcgcggccattgtccatggaatcggccacaatttcaatccgcagtatcagcttgattatgcgatggcggctgcagttttgaagctgaccatccctggggactttaacctttcttcagatgccgagatcaaggcggcgatgatttctaacaatggcaaagggaaaaatccagttaatagataacaatcagcgtgggaaaacaagcgtttagcttccagaggataaggggattatctaaatatccagggtttggatatttagataatccccttatccggccggaagctgcttgttttcccactgttcggctcggtaatcggtacacactaagagaatgcaaaaggggttgcgacaaaactaatcattttgccggcaacccctttaatatatcctcgttcatagttaaaacaaatataattaagctcatctgtccaaagtcctattgattcttccggatggtttcccacaacccattcaaataggtcactcccagtgcccggtcgtacaacccataccctggccgtccctgttcaccccagatatttcgcccatgatctggtcggagatagccctcataatcgttgtctgccagtgccttgacaatctcatacatatccagtgatccggccgacgacaaatgagcagactcatggaaggctgtttttgtctggttcatgaagcggatattacagaaaaaattttaaaaaagttattttaaacaataataaaatatttttatacaaagcaacctctgaggaaatcgaaaagtttattgcttatcttatgcaatttgataataaaattgtaaccatctatctatcaaaaaactgttatctaatggcctcattagcatttcaatcatacaattcacgagactatttcacttttggagaaatcgtattgctattagacaagtttgatttttcattaattgttcaaaaaacattaaactatgtttttactctaaacaagagatcagatggtcagtttggcttcttagatatagtaacaaaagatgaagcgcttgaacgaaattcaattttagaaaaacagtatatttctcagactacgtccgtcttttcgtctattcatactttattggagggatactcatgaaaaaaagtaaactcatacaattattaaaaggtctatcaattagtaaatctcaaatcatatttgccagtactttatcagtttcttcagcagcaattcttttgtatatgccacttcaggcaaaacagctaatcgataattttgaaaacaaatttaatttacctaacattttagctctgggagcaacgctaattattcaagcaattctatctgccatttcttattacttgttaactcgtttagctgaacgaactgttaaacaaattcgtgaaaaggttagtagccaccttctgaatgtaaaacaagaatatctggaaaacaatctttctggtgatttggctagtagcgtcgtcacgaacaccgaaacgatcagtcgccttttatccagcttactgccaaatgtagttagtggcttaacttccgtaattggtgctttatttttcttgtgtatcatgagttggcagttaactttagttgtttttggcgccttagtccttctaatgatcgtgattttaccaatttcaaatgttaccaatcaaacttatgaagcgagccaggccaagtccaatggtttagtcggtcaactgaccaactatttttccgaaattaagcttttgaaaagttccaatgctcaacaagaaactacaggtaagattaagcaagaagtgactgctctctatcttttcggaatcagaattgcgaagattaattccattatggatccgctcgtcaccacagtcatcatggcgactattttagttatttttggatttggtggttatttagtttcagtcaaaacaattacaattggcactttaatttcatttcttttgtttgtctttcagatcatcacaccatttgccaacgtcggaaacgttataaatgattttcaagctagcaatggagctgctaaacacttgattgacttgctagatttaaaggaagaaaattactcaggaaaaatcaattttagcttgaaaaacagttcaattaattttcaaaacgtgaacttctcatatcatgcggccaaagaaactttgaaagacctagatttaacttttaaaaacaacaagttaactgcgttagtcgggcccagcggtggtgggaaatcaactattatttcgcttctagaacgtttttacgagccaacttcaggtgagattctccttaacaattgcaatatcgacaagctgaacttaaagagctggcgtgcaaaaattggccatgtccctcaacagacaagtgttattggtcaaactctgcgcgaaagtttactctttggtttaaatgatcatcaaatttcggatgcggaaattcagaacgctctaagacaggcctacctatctgatttcatcgctaaattacctaagggtttagatacaccgattgaagaacatagcgcaaatttatccggtggtcaagtacagcgcttaatgttagcacgagccctcttgcaccgacccgaattactgattctggatgaattcacgtccgcacttgatagtgactcggaaaaatttatcaaatagtctatcaataatttacgtagccaaataggaattgtgattgtagcacatcgactctcaactattaaagatgcagatcaaatttactttatcaaagatggcactgtagctggattaggaacccatgaagaattgataaaacatttaccactataccgtaaatacgtggaagaacaacaactataaacgaataaactacatttcaaaattcttagctagattcatggaaaagtttggcagccggggttgccaatgctaaaaatatatgataatatacttaagtcggttaatgatatgggtggttagctcagctggcagagcaacggactcttaatccgtgggtccagggttcgatcccctgaccacccataaataccaattaatcagtaatcatgctgctattcgtagccgtgattgctgtttttttatactcgtactgttatacaggaacacaagtgattatgcaaatatttgctttgagccaaaaaaagaaggagaaataatttctccttcttttttaatcttgatgaagcattgtactaataaggctaatgataccaattgaggcacttgggaaagcaaaaatctcttggttcagttgattggctgataaacgatcatcaatgataaacgcaattaaattaattaattcaggagcatcatttccataaatgctagctcccaccaagtagttttcttggtcaaaaaccaatgtaatctcagcatctaactcatttttatattgaaataagagttgtttcccataaggtaacttttgcgtatggtaatggggcgactgctcagcttctttaggtgtaactcccatttgggcaattcttggtaaactataaaccacacttggaatagcggggtacttaatttcctctgtacttcctaatacttgttgggcaatataattagattcaaaagttgctgtcggggttaaacgcggaatctttttatcaatcacatcgccgctcgcataaatatttttaacggctgtccgtaaatgatcatcgaccacaatgccaccacgggttgttttaataccaacgttctcaagaccgagattttcaacattagcaatccggccagtggcatcaaccacgtaatcggtagtaatggtacgctctttattcgtcaaaactttgtactgatcaccatcttttttaacttcagtaactgcttcattgaagttaaattgaactccgtttgatttcaatttttgaataagcttagccacagattgttgatcaaacgcacctaaagcatggtctgtgaattccacaatttctacggtagctcctagttcacttgccattgttgcaaattcgattgaaataacaccagcgccaatgaaagtaatatgttgtggtatctgtttaagatccaagaaatcacgattatcatgcaaataattttgactagggatattcagtttagccgcccgctgaccagtcccaatcacaatattttgagcttcaaattcttgatcgttaactgacacagtatgttcaccagttatttttccttcacccattaaaacatcgatacccaattgtttaaataagcctgccatttgaataggcaatggatcaattgccttatgtttataatccattagagctgaccaatctactttaggagcatccgagatcccaatcccttggtactgctttaaccgatctaaaagttcaaatgggccatctagtaaaattttaggatcacagccatagtttgtacaagttcctgcaattttatccttttcaacaatggcgactgttttaccagcctgacttaaggtaaccgcagcatgccaatttgcatgtccgcttccaacaaaaataatgtcatattttttcataaaaattcctcctagcgttaatttaatcgtgcacgactaatctgatgtagaaaaaaagcaatttatgccaaaattgctttcagttgatcaactagcttattatttatttttaaggcgtcttcgtattccttaatatcaaacgcctcgtgacttgcacaatcgccaattgccttataaatagccatttcctgttgcttagcaagattcgttaatttaataaccaattggcgatgatcatcatccggttggatccgttgtacccagcctgagccttcaagtcgtttcaaaagtggcgttaatgtattactgctcaaatgcagcttatcccccaactcatgtaaggtttgcatgtcttgttgccaaagggaaagtaacactaagtattgtgggtaggttagtccaaacggtttcaacgctttttgatagaattttgtaaataatcggctcgcattgtaaaccgaaaaacaaagttggttagttagtttcatttcatcatcaatcaattttattaccccatttcagtcgtgcacgatcgttatagtctttacttcatttatttacaacttagcttcattttagaataagtcatctgtatttaataattcttgggtttgtcgttgattcaataaattctttgtataggcatgtccatacataatagagaacaaagtatccaaaatatattcaaatgcgatttgagaagcaaacgtaccaattttactttcattttcgttttcatcttgcgtagaaacaatggttaatttatttttggtacgtactttaatctggcgattgccagtcaataaaattgtcggtacctgctttttttccaaaaaagccataatctgcgtatattctggaatgtttgccccatatgatataaacaaaacacaatccgttttgtgaatgttggaaacgacccatttctcatccacatactcttcggcaatgacgggaaaaatatcaagcttaattaatttattttgaaaactgcgggctcgaatctgggaatcaccacgaccgaagaagaaaaggcgtttagcatctagtaatcgctgggccgcctgctcaagttgtcgcgggtcaatctgagcttgggcacgtttgatcgctatgctggttaaatttgccatatttttagcaatcgtcgtaaccgagtcggtgggattaaacggaaaattagcgtctactgcccctaaagaaaccaattgctgagtcaggctatcgctagcagccagttttaattcccgaaaacctccatagcccagttttttagccaacctcacaatggcagaatgcgacgtgtaagtgtcagcggccaactgttcaaccgtgatggctggaatatccgttaaatggctttcaatgtacgtcttaattcgtttttcgttgtctgttaaatcaggttgttgatctaatcgctcaagtagcgccaaattaaccactccttttttaattttacagttactaaagttcctaatttttggcccaaatgtttaataaactggctcctcatctcaataatactgatactttcggccaatctgccaatatcaatagcttttattcagctgaactccctatactgaatttatcaaacttaggaggtcattttaaatgattaatgttgcttatattggcaatggtaaaagcaccaatcgttaccatctaccttttattttaaaactcaaggatcgatttaacgtcaaaacaatttattcacccagtggcagaattcggtggactaaaattcctgatgtgcactacaccaccagtttggacgatatttataacgatccagaaattcaattggttgtcgtcacaactcctagtcagttccattatgccacagcaaaggacgctttgagccatggaaaaaatgtcgtcgtggaaaaaccttttgccgaaaccgcagaccaagcccgcgagttatttgatttggccaaacaaaaacatctctttattcaatgttaccaaaatcgacggtttgattcagatttcttgacggttcaaaaagtcatcaacagtggccttctgggcgacttattggaagttgagtccaactatgactattaccgtccagaagttcctgagcaagctcctgggttcagtaaaatcaatagttttctttatgggcacgggtgtcacactttggatcaagttctcagcttttttggtaatcccgataccgttcattatgatgtgcgccagttgttagggagcggtcatatgaatgattactttgatatcagcatgtattatggtcaaatgaaggttcgtgtggcttccagttactttcggattaaaccccgaccaagttttgttgtttatggtaaaaaaggcatgtttgtcaaggaacgtatggatcgccaagaggaacatttgaagctattttacatgccgaatcacgaagattttgggattgaccgtccagaagactatggcactttgacttactatgatgataatcaaaactaccatgaacaaaaggtcgtcaccatcaacggcgattacagtcgcgtctatgctggcgtttacgcaactttggctgaaggtcaaaagaaactcattaaagatgaagaaactatccaacaaatcaagatgttagaacaaggaattaaacaatgtcattaggaggattcaaatcatgaaactagcaatttttggtgccggtaaaatcgtcaatgattttgcatctattgtagacgatctacctggacttgtcgtcaacgctatttttggtcaagaaaaagatgtgcctgccatgcaaaaattacaaaaaacagctcatattgatgaaatttataccgacttagataagtgcttagcaaccgatacagatactgcttatattggtttacctaatgccttacattttcagtttgccaaggccgcattggaggccggaaaaaacgtcatctgtgaaaagccatttacgttaaacgagcaacagttaactgaattaattaacctggcagaatcaaaacacttaattcttttagaagcgatcacaaatcaatacttagctaactacaagcagcttaaagccgatttatcgaaactgggaaacattaaagttatttcttgcaattactcgcagtattcctcgcgttatgatgcttttcgtaaaggaaccgtattgccagctttcaatcccaaactgggtggtggggccttaatggatcttaatatttataatatttatttcattgttggcctactaggggcacctaccgaagttcactatctagctaacgtcgaacgtcatatcgatacttccggcgttttaataatgaactacccaaaaactaaagttgtcagtatcggggcaaaagacgtggatgcgcctgtgacaaccacgattgaaggtactgaaggatccatcgtggtaagcggccctactaatgttttggaccactacaccattaaattacgcaatcagcaatcacaaatcgtcgacgttaaagttcatccacatcgtatgttccaagaattcctgcaatttacgaagattgtggattctcacgacttaaaatttgccgaacaacagttacgccaagatgaagttgtcatgcatgtaattgaccaagccctagctgaaagtaaaatcaagttaggttgaggttcaactatattcatagtatacaaaaaatcgtcctttctaatgaaggacgattttttagtggttatatttttatcttagtaccagccatttgcttgccagaatgctttagcagctgaccatgaaccgtaacgtgaagatacgtatgagttagcaactttttcttggtttgcagctgaataatcaccatttaagtatgaagcacttaattggtatttaccaacgtactggccattacgtgctgtatatgaaccgcctgattctttgttagcgatccatgctttagcagatgatgagctacttgttgtactactcgaacctgtggtagttgttgttgaagttgtgctttgtgttgcgggaacagtagcaacttctttcttagtagctgctttaatttcgccgtcgctcttaagcaataacttttgaccaacgtaaattaaatcaacgttcttaattttgtttgcttttgctaacttgttgtagttagtatcattattaaacttatattcaatacctgaaagtgtgtcgcctgatttaactgtataaatttgatcggcgtgggatactgtaactagcaatgtaagaccaaagaataatgcggccataaaggctactgcgaattttgttacgttatttcttaatgtcatatgtgtttgctctccttgtgtttttaatctacctagtacaatacactccaattgtttcagttatgtttcaacaacatttatattcattgaccttcacgcaggttcatgtcatctttttgtaatataagtcccgaaaacatttaatttaagtgaagttaatcatacttcgtccttactcacactaaggctaataaagctaacgataattttcaatatgttagcataatattgtgtacttttttaatttttttagaaaagtttctttgttaaaataaaaatctcatatttggtaaaacttttcaaatggacgtttcggtaacgtgtctagtccctttatagtaaaaaattgtgcttcaatttaacatcagcaggaaggatttaaactataaatgtatttggatatacttaatttctttatttcactcttatataattttcatgatatttttcaccaaattctctataattggatgtataccttttattaagttaggagtcctttcatgatatcaacaattgctgttttagttagtctaattattgctttagcacatatttactttctatatatagaactatttgcttcctacgaagtcgttggtaaatttttcaacatcccagtaaatattgttaaaaatgctatgatacaaagatttattcaaaatcttggtttgttcagtggctttattggattagttattatcttgaccttgatcattgtccctagtggcccaatgaagtatatgttaattttcttaaatctatttgtacttctaaacggaatttacgaaggttttgttttttcaaaacgtttcttctggtacgaagcgttaccgggagccatcgccatcttgttggcaatttttatgtaattaaaaatgatttgcaaagaagagccaaactgaactttgcaaatcatttttttaattttaattactaaatcacatggccagaaaaactaggcataaagccactgctaagtgactgaactgacacgtattggccgggggcaggagcggcaacatatttaccatcacctatgtagattcccacgtggtaacttgccccttgcgatccccagaataataaatcgcccggttgtgcttgtgcaacagcctgttttgtcacatgactttcttgagcaaccgtgtaatgacctaacgattttccagccgcatgtgcgtaaacccaatctgtgaaaccagaacaatccatgccacttcttgattcgccaccccaaacgtaagggatatgcatcttggctaaacttaaagcctctgaaactacagcactgtttccggtggaactggtcttcaccattgtttgtacagtttgactattttcggcagtttgagtagcataatattgttgattaccaccatcgttcgcattagcgctggccacgctagctgatcctaatgtaattccagcgactccaattgcaagaacaagtgcatgtttaaaatttgttttaatcatagacgccctttcggttaacttatttcttatcattataacaagtaacatcttaacatgcacacaatacgaacatttttaaatctatttacaagctcctttcaaaatattacaaacgattacaattatttgaatctgcccacttcattgatctacaatttccccaaataattaacttcatctgaaacaaaaaaatcagtacttttcagtactgacaaagattatcaacttaattgtattccgttaactcatgtttactccgctcaatcattgcaatattaacaaacaaaattaaagcaataattacagccgcaaccacaaacaacgaaacaaatgagagggtatcgataattagacttcctactagcggacccaatgcacggccagctgatggaaacgaacttgccaatccttgatagcgtcccttcatcccatatggtgataagagattagcaattgccggaatttgtggaaaggtaactgcttcgccaattgtcaaaataatcattgcaagcacaaatgcaatatactgtttggcgaaaaccaaaatgacaaaagaagcaattaaaaataacataccaaaatagacttgatgaaaaggatctttgaaaatctttccaccttgccaacttagtaaagcttgcacaattaaaatgaagaacccattcactgtccataagaaactgtaattttttaacggaatatgcagactcaacatgtaaaccgaaatattactgttccactgttgataaaaaatccaaattaaaaatagactaataaacaaggtatacatcacaactgaattgatatgcggtaacttttcggtcttggaagccactttcgcatcaggatccatttgatgctgactctttggaatttcccgtttcacatgataatttagcgcagctacgaagaagaaaacaacatataaggcagtggccactgcaaataacggcgcaacattatctttaaacataattccaacaattgcagtaccaaccatgacgcccaggttttggacaaaataaatcatattaaacacaaagcgcccatcgcggctatgcaccgtggttcctagagcgttgacaaatgccataatccaaccggttcctaagccaatcaaaacaagcataattggatagactggccatttatttgaaaacacaagtaccaacatgcttaatgccgtgaaaacaatcccacccagtaataggtagtaaccatcatgtttatcaaacaattgtcccgctgtaaaagaaccaatgatacttgcaactgagtttagtaagagcacaattcccacaattgtgagtgaatgacccaagatgttatgcatgtaaaccgttgtcaggggccacacaaaactcatcccaatactatctaccatggatcccaagagtaaataccgtaattttaattccttcatcgtcctctcctttcctgtaaaaactaacttaaattaacttaaaaaagtcattgtgaactctggcataatttgtcctatgtagatgaaaagtaaagccaatgaagttatgtagttgttgtatggtctgcatgttcatctgatgacaccacagatgataggcctgatctgaaacacagttaaaaaatggtaacttggccgagtggtctaaggcgccaggttaaggtcctggtctcttcgggggcgtgagttcgaacctcacagttatcatttatttttttaattttttggtcgagtcttttactcggtacgccatgttgagtagtcttcaaaaaatgaacactttaaaattcttttttcctacagttcagacaatgttatacttacactcttctttttttaaaaataggcatgtcatcaattccaaagtcatcctcaaaatcaacgtagctggttcttgggattttgttatcattcttctcttcgtcattgaagaccaaccttctggcagatttgaattcgtagttatcgtcacttgttgtgacgttgttggacttgagttgcgactcagatgcggtgccaattaattttggccatttcttagcactattcttccgcggtgaagggagctgcgttggtaacttctttgggggtggggacttggaagtcattttgtaactatcgatgtcacctgcgacatcgctaacatcacccatatcgtgctgtgtttgaaacgtaccacctgagacagaccttgcatactctaaaaagttacttgcaggcttaaggcttctgggtgcgaaaatacaccattttttatctaaaacgcgtggtagtattcctgtctgcgaaagctcccatataaatgcaaggctcaccacaggtatattccattttttagctgaattgattttctttttcgtcagtgtgatagcttttgcatccatgttggctttgcttgtcaaaatatcaccatatttatagacaaatagctgttgagaattggatttattcacgcccaaagaggataagttggccactaaataatcacagtcctgcgttaattccgtcgataaggtcagtttgagatttttgatgagtttacagacgtgtaaatgttcgatgtcacagaagcctgtaatgtggattttcagtttatagttcaagaataagtgcggaagtggtagggaccatgaatcgttcataattttcttgtaatgcaaacatcgttcaataaaccattcgttcacaatgtcggtattggacaagctttgtaacttcaaaacatcatcaggtatttgctcagctgtgtatgtagaaggtataagcacatgagtgacactgaaatcgtactcgtcctgtacttcagctccatttgttcttaaaacggatgacaatttctcaacttgctggtcattaaacccataagttgcaaatatgtaacctttgaatagagataaatagtctgaggtgcttcttcccctgatttgggccttcctttggatttcacaattcacttcctcgaatagtgggttgttttcagttgacccataattgacaacatttctgtatcttttataagaatttttccccaatagcttaggattatcaagttttgatatatcatacaactgagggttgagtattcgttgacaattgcagcagtctataatccattttggatgtaaaggaattatattccaatccaaagcactctcatatcttttaccttcttttttatcggtaatcaaatatgttaccttaggtgtcaaagaagcgacggctttgcctccaaagtggtcaataagtctggtgatatagtccttctggtagcaaggattagacacatcccttagtcttgaaagacagaacaaacaggagtcaaatattggccatggatattcatcaagaatgccaatggtgagattcgttaaacttttctctttgaatcttttgaatatatcaaacaagtcatcagggtatatcagggtaacatcagtacgatgtttcaaacagtacttagacttctctgtttccatatttccgactaccaacacgttagtttcgctggttaggtcattatttattttcccacccatggagtagactgcgtctgccaccaaacgcttttcatggctgttgagatctgttgtggtgaaagtaacaccgtcaaatagaatctccgacgcagttggacttccagttccatccagagccatttgctcaactagacacgtactacaaccccctccaaagcactgaatggttaagtgtttacagttcatctcaaagcaaaatttggaaaacggaaatgaaacgcaacgacagaagagagcgatttgttgagattccagattcgacatgttgaagattgaaggtttgaagtatgaaagcaacaaacaggctttggaaacggtacaaggcatctcacatacagtggcaacacacatcgacaccacagaaaagtatagagattactgataatgtcgggctcaaacaaatcaacatccgctcagaatcacaggcaagggcaccataaatctcacatccagtatgtggcgaaggtgagatactccaacaaccttccaccaccagcatgttcggcaaagctattgaaggatgataaggaggattccaagaactctgaacttagtagtttagtgtcgtcctttttcaggaaagagaacttcaagaacttgattagactcaatgacgatttgggtatgccattgaacatggccacattagcagctgaagaatccatctacgggttgaccaactctgacggaatgaaactccaactccacccctctgatgagctgttacttgcagatccgaacaagaacatcaaaacgaagtcggactctgtcagtttcttgagaagaacacaatatatttcagcagatatagcggcacattctacaactgcaactaacaattcacaaaaacttgcacaaatgaagttacaagaaaagaaggatgacggaacggatccaaagtcacaactaaaggccgtcgaggacatgttcacatctggagaagttgatttaagtagtataaagcatccaacgaagaagcacctcaaagctaaaagagtctggaatttcctacctgatacatccatgctggatcaatcatactatgacatcaagtttatgagcagtgcaagtatttcaaagaacaaagacaaatcgaagaactcaatcaaatctataacagatccaagacttctcacctccatcttcaaagaggtggatctcaatcaaactcaaaagttgatgtccttcttcctaacagatgcagatgaggcagcgaaggtagaagagaagcttgatgactttacagaaaatgcacctctggacgataacgagcttgaggaaatattaaaggatgaatccaagaagagcatttacaagaaacaaagagaatacgactgttcggtcaaacctattgacccgcttcgtcaactggtgattacatttgatgagaagtcagagaccgcatactatattccaatctctggaaagatggaattgaagaagtgtagaattgatccatatttggcaccaaagattaaagaaatgtcgtatgaccaaatcaatatgtttgtcagggaaccaactaaatccgagattgaaaggagagatatactcagaagcaatttcgatccaatggagtttggcgctgacgaggatgaagaggaagacgaagatgccaatgagtgattctatatttttgtattatatgaagtaaaatatgcccaaaatatacagtacataggactctgatgaaggttgaaacgagttttgttaagggtaacagaaaggtaaattttattggatgcttctaaagtgtatatatgaattgggagggaacaatgaaaagaggaattgtagatgacgagtttactgcaccactctgtaggttctagaggttcctaccttcccttttatagtgcccagtcctatagtacccgatggggctgatgcaacggctgtgtacattggagtaaacgtctgaacccaattagaagagtacaccgaagtaatgacagccgtgccggaagtgaagatggtggtcagccaaacctgagtgttgtcaactgtggtagtagttgacaacttcgtggtatatgggactgcctgaatggttgttgatggagttttgacaggcacataatgagttgcagcttgctgattaggatcagcttctgtcttcacggcacccggtgtagtggttctggtggcagccggagcagttgtaccggtggtagcagtattggtagcagtgccagtggtagctgtatttgtagcagtgccagtggtagctgtatttgtagtttttgcgttggccaaagtctttgtggtcgctccggtggtagttgtgtcatttacatttgcattggcagcaggagcaacagtagccggcgtggtagttgttgcctgagtagtagctgctgcagcaggatcggggatgggtgttgtcgttgtggcagcaactgcagccgcagcaggagtagcaattgccggtgtggtagctgtagcaggggtagtagcttttgctacatcagcaggattagggacggctgctgctgtggtggtatcagccactgctgcagcgacaggaggagcagtatcagtgttcagatccgctgctatcgttgccgcaagaaatgctagtatgaacagaaggaaggagaagttgatcttagtgttcattgtgtggatatatgtgagtatagactggagatatgtgtgtggtatcttatctcttcagctaaagtgggtgtatgcgaaggggtgaagtggttattattagtgatggtagtgtcgaatctataagggcaggcttcacttgattaatgtagcctgtatgcaatgtgtatattaatgacagttagctaaagaatgttgagcgtctgtgtgaagcaaatatacggtagtgaacgtttgtgtaagtgatcgatgagtgtaactatgcgtgaggacgctctttcgctgagtcaaaggagttgtttcgtgtttgttttgagcttgaactgaaagataaaagatgatgagagtcagtcctcgcaaggtttaacgactaattctgggttatgtgttgttctagatgttggtgccgtgatgttgggaagggcaagagaagtgggtgcaggcaaaatgtcaacggggagagtcattatgtactttgctggcagctcatcccggacgagatgatccagcgggcatctgcacacgttgatttggaaaatttggcgtactgcgaccgaaggaaatcgctggaaataggtgaatatcaacaatttaaatgtatataaagccataaatgggggtgccccccatttaacctgccggtggcagcgtgggcgcgattcggtcgaatgtgtgttttcaacacacaagtcctacgtagctgtctgtaggatttaaggagtgtatagagtttagtgaatcatgtagtgtttaagaatgtatacagtttactaatgttctattggtgtagaagggtcagcagcggcgtcattgcgccgaagtcgatcggttacatctggagcgacgatgttcttcaactcttgttgtcctcttcctgccataggtgggtggcacaagtatatatttcgaggtgaagtagccctagaaagggcaacgtatagatgcccatgagcaaagacgtccttcttcaagtatataccaactctaccagcaaacgtttgtccttgagacttgttgatggtcattgcaaagcatagacgaagaggaaactggcggcggacaaagtcaatcgggcacgaatcttcaaaatcgtgatgaaagtctatcctatgaaaaagggctctcttccctgcacgtacaccgttgagaatgatgcactcaacacatttggcattatcaacggtgatgatgtctgtgacgataagccttgtaccattaaccaaaccttcagcaggagatagatttctgatgagcatgactggtgcacccactttcaacttgataataggatcaggaaagcaactgttcctataagcattcatccttttgataagggacctgtgcatcatattagctcgatcaagttgtaagcctccgccaggttcatccgatgcttcaaagatcatctcttggccactaactctctccaacaacatactatttaacattcgaacttgagcattagttggggtaagtatgcaattatccgtcagtagccgcatcgcaatgttcagatcctcagggacagcaagctgtccacaacttcgtagctggccaattgggaagattttcttcaggaaattagacatacacctgtcattatccggatagtatgcatcgacattctgggtcaacagcctgatgttttcaacaccgacaccatcctggaggttatatccacttccaattcgtagcaacaattgagcctgttgacgtaataccaacgtctcctcccttgagacctccgcggagagaattcgcatgttttccgtcattgtgaggaagttcacttcaggctcaaactcagcacttaggatgcaccgcttgacaatttcagaaagtggtgctctcccgacaacaataggcaagcactgcctaaaatccccagaaaagacaaccacacacccaccaaaaggcttgtttggaacacctttggcctttctcatcaagttatcaacgccgccaatgatagaaagaggagacatggtgatttcatcccagaagatgatatcgcaatcctgaaaagcatccatcatttgcggacggggattgcaagcaacggaaactgaaggactacaggaatgctcctgttgaagaggaatggaaaagcacttgtgtgctgtcatacccttctccaataatagagctgctatacccgtggatgcaactggaatcaccaacctccctttgaatctcaacgcctgaatcatcaactccgtgacaaaggtcttgccactacctgcaggagcatccaaaaagaagatgttcttaccatcatcaggtccttccaatacagccttggtaatggtttcaaaatgggacctctggaccggagtgagcctggatagttgcatctcatgcacctctggatctgcagacgtgtggcggtagtcgtgatcgtaaccgaagctaggatcaagcgcattgtctctcaccaacggaggagcaacaaaactctcgcaaaggacaatgtcactcgcagagaagttcatcacttccattgtcatgtccggaaccatattgtcaatgagaaatagcaaatatgccctttccatcatggcaacatcagctaagtccctcacactttcgttctcatataggatgaatccatgtttccttctatgatcctcgttgagatccgcagcaaggaatctgaaaacatcagatatgaactgagaagggaagaggatactcttagtggataggagttgtgcgaaactctctctattgacatcctgggtctgaccggctgatagaaagttgttgatatattcggcatcggagccaataatcccaagttcgaggcacgcttcttcgaaggtgtcatggcccagtttgagatcatcaaatgattccggacctctgacatgttgaagcaagagactcacgtaatagcgttcacgatcattggaaagaggagacacaacttgcaaatacgctagggtagcagttttccgaacccttggtatccactcgcctggcttcaaacttgcccatctgaaacgcttgattacatctttgtagagcagtctcgagcgcagctcatcttctggtacaaacgccaaattatctagaatcccacgctccacatccaacagatattgcgagttctcttcttctgaaacttcctcctcatccttcttctggaggtaaatccgcactcgcttgttcaggcgaaagaaccctagcagcttactggttttggaaccgtcggcactgttccgctcaatcatttcgttgacctcccccacatcatttctgccattggtataacgaatgttgaagcccgcttgaccatgcacgtggagatcaaccattgccggtttgatctgattcatgtgcttggcaatcagctgatacgaagcctgagttcctgtgattaacttccccttgatgtagttaccaatctgatcgattgttgccgaagcgttgttaccttcttctcctgacgctaatgcagcacctctatttgttttgacggtgtctgctcctttgtggatgtacttgtacaggtactccacagcacctgtgggtcccacaacgtctagattgatgtgacagaagaagcgatacaccaaagttgggttgtaagacaccgttttagtgtcagcaacgcctcccggtggaataaaccttccgaactctgtttccgtgaaaacatcacattccgggtggggaaaatgacccttcttacacttcttcgggttaatattatcgcctccacaatagcttgccttacactcgtgcgtgaaaagagcggagaccataccagacagctccagatctgttggaaggcaacgcttgatgattcggtcaagcttttgaaagtcaaatgttgcgtctccatcctcactctgtacatctaactcagggcaacggagcaccatgtgaatatgagggtttccccgctgctggaattccgtgatccaggcctttcctgacaccttgagacgtagttccttctccaaatccgtgttcaaaatggttatcatttcatagaacaccctggaaaccagatcattcctcaccaccttgtcttcctcgcaaccatttaatcctttttgcaggtccaatgctaactttgggttcatagtgaacgtcaagaagagattagggggtccaacctcccgaaacatgttgaatgtcatttggtataggcgactgaagtatggctttgtaccgtaaatgctgtttggaagaaagctaaccgttctgctagccctatccaactcacggccattgttaacagacgcattgggtgagatgtacctggtattcttctgatgcaatgcatggaaaaataaccgattttgttcaatcatcatccctaccgttgcgtaaaactcttgtgccaagctacccacaatatgtataggattccaaaccataggttgatcggcaaggttctccagcacatcagcagaatcgcttttacaacggcgctgaattagaaactgcatgaactccctcatactgatacgcttggatcttttatccgttgtgccttgaagtggaaggtctgtggaccatccactctctccgtgcaaaaagatgaggggaaaccgcatcggaagaaagaacgggtgcgttatattcagcagcttcaaggaatcacctttggttttgataacaaacatcatcttttcccccagatgagactggtcatatgcaattccaaactcgccaccgtccggaattgaattgtttgtccgatctctctgatccgaggcctggtaatagatgctttggggaatgttaccatctgggtgattatcacgaacctgctccatggtagttttgaaggttttggcgtaaaaattatgctccttcatgtatttatggatgtcagtaacaaatccttgaagggtttcgtaatcttccattgacaatccggaacgaaggttgccgctcggtttgcaaaatatatcgagaagttgaaggtgctttgccgttgcatttgcatcgctgtccatagtccatatttctgcgaaccgtctcccgtttgagttctcgtcactgggaattagaccaccagccttgactgtgactgatcccgttataacggcacacttgacaccatttcttgaatcgtttttcagattggataagtcaagcacaaaggaaagaactttattcagaagaatagagtgcttctgaaaaagagggtctttgtaaatatcgacaattctctgcggtggctctttaaaccagtgtttggtgagctgaatcttaccattgcagcagcaaccgtctagtgtttctttcgggagtctcaacgcgtgacagtgatggcatctctgcttgaaagatgctttatatctaggtagattgtcagtttcagctttgtacgtaaaagcctgagggttttctgggttgatacatgattcaccaatcacttccccactaacaggtggaggaacagggcctattggtgggcgtgaagtgagaacaggggatgtcgttggcaaggatattgtttcgtcttcatcatcttcatcttcttcgtttacctcatccagaagctcttcaggcacttcctcccaaacctcacattcatgttcttcttcttctgcaaaatcagcatcatcgtcatcatctagaaaggccgtgttgtacctattgacatcatcatcatcaacgattacttgagttgattcagccaatcgtctaattcgctcttcgtaacgaagctgaaaggttgcatcagtttcaggtagcgcatgctgctcggtaacggagctcatagtggttgcttcagagatatcgatctcaatttcaacaggaagttgttcaaaagcttgttgctcagctcgcacacgacgcgtatctctggcgattcttgcagcctcaatacgttgtcttctggcgattcttgctgcctcgatatgttgtcttctgactcttgttgtaggtgccattgtaattcaactttgcttattgtagttaggaatccaatgttatataactaaatgccacagaacactcaaacaaacaaaaaacatgaacacgaacatgaacacaaaaagaggaacgcgaacgaaaaaagattgaaggctcagcaaattcagcactcactaaaacaccactacaccgcgacatgcttttctgttgcctccatatctttaggcgctattggggctttagagagaagtcctatagggctgaaatttggccaaaagatggagacgactacaatctagacgtaccctaaacggaatttggagttaattcatattgatggaatgacaggaaaatcgcagcgaaaaagtggcaaaaatggcgaaaaatggcgtacgtaaattccgattaaagcgttcattactaccacgttcagctggagtataggtaacggtaatcttttctttgtctggatcttgaatataacctgtaagggcttgatctgtatcacttgcataacgatatatatatgaaatattgatattattgacagcctgatcaagtttaatgttcgcattaacaatcgttcgcgccgatttacctgaagtagttttcgcatttgaacttgcttctgtacttgagctttctgctgaactacttacttgtgagcttgagtcttctgctgaactgattgcttgtgaacttgaactttccactttttcgactgatgaactcgatacactgtttttgctttcatctgctgtacttggcaaactcgatgaactactcgtactttctgctgaggaagcctcagcttgggctcctatctggactacattactagtcagtgcctgcttactatccaaaatacttattgaaaattcacctgcagattgtgcaattaacttaatgacaaaatttttcgaggtttttggagttaaagttaagttcaacttatcgctctccaattgatacttaaatccatcattagtagctgcttggctaagtgccgttttatcaattatcaccccggttggaataatcatactaaaatcaattgaactctcttccaccgttttcaattgatttactttaatttcaaccgcgtcccccacatgaacagagttttgcgagatgacaaggttaaaattcggttctgcatcatctgcataagtttgttgatgactatacaatccgaaaatactggctaaagtgacaaacactagtaacgactttagaaatcttttcacaatcatcacctctcctcaaaactaaccgcttcctttttacaagttaatcatagcaagttttaactgatagcgatttcatttttttatagttaactcaaaaaaattgcaagaattcatatttttgtgtgcgttagagctctcattttctaatgtttaatcatatttccattcaaaaaaatgcaaaaaaaaaagagttaaattctgagtataatctagactactcagaatctgactcttttctacattttaggaatagtatttgggaaatagcacgagacccagctaaagcctatttttcccattctttttctctactattttttaaacattaactgatgcaccggagtcttttcataaaaatgagtttcaacgatttttttaatcgctactaaatcacgagtggtccctagattagttagccaatatgtataatccgtgtcatcgtaaggctcgtcgtgataattcgttagcaccaaatcataggcattcccgggctgataatagtttacattaactcgcaagtctcttttaaacatctggcggataagatcaataatcaactggctaatataataatcaaaagtagtatctacgccaatattgatatccttaatctgttggtatctaaaatcacggatcgcaaatagtaaccgccgctgaaaatagatccaattttgttcaattaatttgctcacttctccatacttggattgagttaacactcgcattatttctttaacaacctggcgtgcctgatgtgagaaaaaatgcgagacatagtagtcagcataaatttcatccatatattccaaattacccgaaaaacaaaacggtcgtgcacaaatatcaaaaactaacttcattaattcaaagggccactggctatccttaatttcgagcgttttttggatcaaatgattcgtttgatccactacctgagacaaccgtgtgtgttgagaattataaatatcgtaaaaacgttgaaccacatttgtcttgctattaaatacagacatactaattaacatgacacaaaacgcctcagattcaaactccgattttgtttgtgaacgaacatgaaagacgcgctgaaatactttttttatatgaaaataaagctcattgttttcgtataattcacgaaccgattctggtattctcgtttgtaacttggactggacaaccaaccgatgctgagaaattgtcaaccacaaacgcaccctatgaattgcttcagagtgaaagtagaaatgtaattcggtctgcacttcattcacaaactgatccaaattaaaatctcgcactttaggcgaataattaatgacttgaaaaaggttgtaataaaagaagcgaatttgtaattcatccccaataatattcccattgtgaatactcaaattgaattcactcaaaacggtattaagctgtttaatagttcgatacaaagaagcctcactaagatttaatttttcttgaagggtatatgtcgtaagacttccatgattataaaaaagcatcacaagttgaaacttgggtgatttttttaaataacgatcaaacagccaatcatcaagtgcaaagtttttgagtattttgaaactcgccgtattggcctcgattttgatttctaccttgttttcatcaactaaaggttgaacatcctcatttaaatcttctaaataacgtttcaacgttgcaggtgaaatttttaattttttggtcaacgattgcttggtcggtaaacgcaatggcaaggagagcgtcatcttgggtgaaatttttaattttttggtcaacgattgcttggtcactggatttccgtctaaataaagaatttctaggattttaaataaattttgttgatttttctctaacaaatccgttttttacatcgttattaaacactcactttttattttttctacttctctagttacactttaccatataacatgtaaagcgtttacaaatataacgaatcattacaataaataaacgcttgtctataaaaaagatgttgcactatgattgagttccaatcataaagcaacatctttaaataccctatctaaaggttaaaaggatcaaaattacttcaataactagtattaaacgacttggttcaaaagcagtagtttaattgccgtcctgcggctccaagtcgtgcctactattccgcctagtaatgatgattttcgttccgaaaatctttcttgctcctgtcgatgtcgattcttgtggcaaactcggccgcaagaactcgcactacgttccagcccgaatttgctggaagacggcattttatctaattttgctgccatgaacgttttcgtatcaagcaacaagataagttttttgtggtttcaacctttagttaacctatgaaaaccagaacacggctctttttgagttttgttctggttttttctatataatggccttcagaaaagacgcttagtgctaaacatgatactattaaagggaaataaattttgtaactgcctgggggaatggctaagatgggtaaaatcagaataaataatatgagctttcatacatttaacggtgtgtttgctgaagaaaagaaactgggtcagcgccttgaaattgatgctgaactcacctatccaattgaagagaaggttctgcacgacaacctgaaagaaacggttagttatgcggacgtctaccaaaccattgaagatttcgttttaaacaataactacaatttaattgagagtgtggctaatcatcttttgaaaaaaattctggccacctacccgactattcaggccgttaaattaaaagtgcgcaaatatagcgtcccgattgccggaatctttgacaacattgaaattgaagtttccggagaacagcatcatgaataatgacgtttatttaagtgttggctctaatcttggcgatcgccaggccaacttaaaacaggctgttaacctgctcgaccagaattcagccatcaacgttaaaaaagtttcgcccatttatcaaacgcaaccggtgggtggcgtcccgcaagatgactttttaaatattgccattcacttgtccacttctttagatgcccatcgtcttttagatgagttacatcagattgaacagaatttgcgtcggaaacggcttattcattggggaccccggacaattgatttggacattttgtactttaatcacgaaacctatcaggatgacacattaatcatcccccatcccgaaattgccaaccgccgttttgtgctgatcccactgttagatgttttaacagatgacaaattgattgctaaaacccagcaacaattacaaacgacgcctgaccagaattgggtagaaattttacatgactaagaggtaaccagaatatgatcgaaaaaaataaaaaaaagatagaaaacgccgtgcatgacattattgaagccattggcgatgaccccaaaagacctagcattcaagaaactcccgccagagtggccacagcctatgaagaaatctttgctgaaactggcaagcaacattttgaggattacaaaatttttaatgttgccgaaaatgccggtatggttttggtgcaagacattcctttttattccatgtgtgaacaccacatcctccccttctttggcacggtcaatgtggcctacgttccgcaaaacggtaaaattattggcttgagtaaaattccccggttggtcgactttgcctcgcaccgaccaagtgtccaagaaaacatcacagtgatgattgccgatgaattacaacgcattttaaaccctaaaggtgtggcagtatcgatttctgcacgccatatgtgcatggaaatgcgtggaatcaacaaatcgggtctatttacgtatacgaataaatttttgggcacctttgccgatgatcacgagttaaaaaacgaatttctccaacagacgcatcagaggtaatcacttaccatgaacgaagaccaacaaacctaccaaaatttaattgcaaaaatgaatcatcaagttctagtcactcaagataatcgggtaaccattttacgaaaaatcctggttgacctccattatccagatcagagctataaaattatccacattgccggaaccaatggcaaggggtcatccggtgccatgttgggagctattttgcaggaaaatggctaccacgtgggtcgtttttccagccccgcgatgttagacgaccgcgaacaaattaaacttgatggacaaatgattagttataaggcttttcttcaagcctaccaatttattagtgacacgctgggaaaccgagatcaggtcgctttgctttcaatttttgagtggtttactttaattgccttggttgctttcaaacaggcaaaagtagatttcgtgatattggaagtcggattaggtggtaaaaatgatgccacaaacgcaatctctgcgccattattgactttgtttacgcacattgattacgatcatacccaaattctcggccataccattcgcaaaattgcgactcaaaaatccggtatcattaaatcgggttcatcagtgattgttgcaccccatcaaaaacaaattacgcgtgaagtcttgcggactgtggctgataaacaccatgtggccatccattttgtgcgtaacattcagttgaaagttttaaatcaggatcagacaggcacccaagtccagattagtggccccctaattaccaaacaagtttatcaactgggcttgatcggtaactttcaactagataatttagctacggttttaagtgctgtaacttggcttcggcaaaatggcacgtcactcgaccaacagtgcgtttacaaggctctatcacagctcaaagttcccggacgtatgcagattattcagcagcatcccaccgttattttggacggagcacataatcctgatggtgctaaacaattagttcaatcattaaaaagtttgtttccaaatcgaaaaatccattttctattgggctttttggcggataaaaattactttgaaatgttgaaaagttacttaccaattgcaactaatgtgtatgtgaacacgcccagtcagcatcaacgggctttagacaaatatcgccttgccactgtgattcgaaatgagtttcattttgctaacgaccatctttttgaaaccaacgattcacacgaagcgcttgcccaagctcggcaaagaagttccacaaacgatgtcattatcattactggttccttttactttatcaaacaatttgaaggtgaatttcatgtttaatcaaccaattctcattgcttctaataacctagataaaaccatcgaacttgccaaatgttttaaggtagcaaatgtgcacgcccagtcctatcaaaataagcttgcacgcacaacctttccaaaggaaggtacgacaagctatttagataatgcgcggcaaaaagcaatttttattgctgaaaagatgcctcacgcttatgttttaggggatgactctggaatgattgtagatacttatccagataaatttggtgttgaaacttcacgccaactagtagattatcctacagataaagataaaaacgattatttgatcaatttggtggccggtaaatcacgaaacgtgaccttacggacagatctggttttatgttcacctagtcaccatctgtatcatggttttggcgagtttaaggggacctttagcgaccaagaacggggccaaaatggttatggctttgacaaaatcctcattcctcagggtgaaactcataccctagccgagatgccagattgtaaaaaggccccttatttacatcgcacaaaggcagttcataatcttctaaaaagggcggttcaaaacgaatatgaatatttctgacaaaactgaagaatttgcacatcccgattcatttgaggctcaaatcgcctatgatacgttacgtaacgcgcgtaaaattgcgttgcagtttaccgatctatctgaaccagaagtggtcaaactaaccaaattattggcagcatttgatgttcccattcgagccaacaaaaatagcgtccagaccgttctccctttgactgcgtttcagttgtttatggaacatttcaaagatcggtttcaaaactctgtcagtcaagaaaagttgaccgaaatttatgtgcagcacggcgtttactggaattatggaaatcagcaccgcgatttaattcaaaaacctttaatttacggtattttaaatattaccccggactcattttatgatggtggtcgttattttgaacctcaaaaaatcatggatcgcgttgctgagatggttgcggctggggtggacgtcattgaacttggcggacaaaccacacggccgggtttcaaagaaataactgccgatgaagagttagcgcgcattatgccttacgtaaagcagatccacgactcctaccctcaagtcactttagctgttgacacctacaaatttgagatcatgcgtgacatcgttaaggacggcgaagttgatattataaatgatgtgaatgccttcactgacgatccgcgtaaacttgctttattggcaccaactaaaatgggcttgttaaccatgcacagcagtcgtgacactgagtatgacaatttgactcaagaaatgcgaaactttttcaagcagaatatagatcaattgactgctgttggaatcgatcgcgaccgtatcgccttagatcccggaattggttatgccaaagttgcagacggttatcaagattatgcgatgatgcgcaacatcgatcagtttaatgattttgaccgccccacaatgattgccatttcccgtaaggggtttggcgcaaaattatttggtttaaaaaaagaggaccgtttatcggtcactcttattgcagaaacttatatgtatttgcatggcggaaatattttgcgcgtccatgacattacggaaacgaagcaacttgtgaagatgcttcaaaccattaacaatgggtattggttcaaaaatgctagtaaaaaagattgagacatttttctcaatcttttttactagttttaatttgaaggtaatatggttgcaaacgatccgtcccaaatactttcatgatgcttgatgattgtttgagcattcaaaaggtctgagtcaaaggttgtggttaatccccttgtgacttcaacctcataatttagatgacgtgcaacccgaattgtggtgtccacgcaatactcagtttgaccgccacaaatttcaacactatgcgtgttgtaggtttttaaataagcctctaaattagtgtgataaaacgaatcgggtgttgttttgacgatgaattcatctttctgcgatttaaagtctaatttgtcggttaattcaaaggcttcggtatcgcttggaatctcatcatcggtagtttggacgaaaaaaatcgcctttttttcttgtcgataaacggcgattcgtttgttgatgcctgccacaactgcatcaaaattcgccattttatgcaatgcattttgcatatcaattacaattaagacatctgccattatatttcctctttcataaatcaagtttgtttgacagtactaaatctaaagtactttcggtatccaaagacgatctatttccctgttcaaggcatcatcaatcaagtaatacgcttatgaactttgcgaataagttcaagagaaatgaattggtaatgcaaatataactccccaaatgagcatcttgtcctattatagtacaactgaatggaaaagaggaaaacgctacattttttatttaagaaattcttaaaaacagtgagtgaaacaaagcggtaaaggcagagaatataagagaactggaggcgggatcgcaatcccgttggaagttttcttatattctctgtcttgctttgtggaactgtcctatatcagtgagtgaaacaaagcggtaagagaggaaatttaaggctcaccgtaagcgggagaattcccgcagtaggtgtgtcttatattttttctcttgctttgtggaactgtcctatatcagtgagtgaaacaaagcggtaagagaggaaatttaaggctcaccgtaagcggggagaattcccgcagtaggtgtgtcttatattttttctcttgctttgtggagctgtcctcaaacccaagaaaaagaaaggtctccctatttaccatcctgtttctgcaccgcagcagtcgctactgcgttcacataattgagtgggttatcaaaattaggctggaaaaacatatccaccattgataagtcatcgatggtcattttagtttgaatggctaatgaaataacatttgcggattgggcacaatcataggaactgtaaaatgccccacccaaaacaacccttgttttgggatcccaaactagtcgcatcaaaatgggcgttgtggttaacataaaatctggccgataattttgttccagtgtcacactttcaaccttgacgccccgtacttgggcaccactttccgttaatccagacgaagccaaggtttttccaaaaagggccaccgcagatgaagcctgcgttcccatatatttaacagttggcttttcaatgttatgaccgattaaaacgccctgtcggatagcgttagttgccaagggaatatagtcatccttgcctgttggattgtaatgcacaactgctgaatcgcccgccgcaaaaatatcaggatcagatgaccgcatatacgcgtcagtaattattgcaccatttggtagcatttttactttacctttcaataaatcagtgtaaggtctgaagcccgcgcacaaaacagcaaaatcggctgtgtaactatccttagttgtttttactgtgatttggtcatcaccttcaaaagattgtaccatttcatccatagccaatttgacaccatgtgctttgtagtcgtcttcaactcgcaaaccaatttctggatcaaagtttttggctaaaacatgtggtaaaccatcaatcaaagtaacttgtttaccagtaaccgccaattgttcagccaattctgcaccaatatacccggcaccaatgataattgcagacttagattttggcgcggcttcacgcaaaattttagcgtcgttccaatctttacaaagcttaaccttgtcattatcgatacccttaattggaggaatgacaggtgcagaaccagttgtcatcaccaacttatcataatgtgtctgtgaaattcttccagaaactaaattttttacctgaaccgttttttgttcaggatcaatctgcaacacatcatgttccattttcatagtcgcccctagtttttcaagctcctcaggagaagaataaaacattttatttggatctgaaacgtgatcaccaacccataacgcaattccacaagaaagaaacgataaattatcatttcgttcatatacagtcacttcatagtctggatgttccgctagaatctgtttggctgcaaaagttccggcatgggttgctcctactataattattttcataatttccctccacaagtttttttgttatcaaaattattagtttattgttaattcaattctattttgtatgtcggcaaatgtcaacgcttacacatctctatttattgctatcaacattatattggcattaatgctatacggtatataatatagattagaaaatatcataaaggagggcacctatgaatattcaagtcagttcggaaatcctcgacggactagttttgtcattactcacccatcaggatttttatggttatgcaattacgcaaaaagtccaagaatccattaaaatatctgagtcaacgatgtaccccgttttaagacgacttatttatctgaatccttgctatcaggctttgctttggttgaagcttttacttcagccgcactgtcgctcttgataacaatgttgccctttgaatctacgtcagctgttaatgtagcagcattttcgtgatccaagtagaagtcggcaaccttgtcttcaatctgctcttggataactcttcgaagtggacgagctcccatagctggattgtagcccaagtcaaccaatttggccgtggccttgtcagtcacgttgatcttcaatccttgttgcttaagcataccgttgacatcgtcaatcatcaaggaaacaatcttcatcaggttgtcctttgataatgagtggaactcaacaatgtcatcgaaacggttcaacaattcgggcttgaagtagtcggtcaacttatcaataattgaatgcgtcttcccactggctgcagcaccgaaaccaacgttggcttccgcattaccctggccggcgttactggtcatgataatgatggtatccttaaatgaaactgttcgtccctgactatcagtcaaacgaccatcgtcaagaatctgcaggaacatatgaagaacatcagggtgagccttttcaacttcatcgagtaaaatcaaggagtatgggtgacgacgaacctgttcagtcaactgaccggcttcttcgtacccaacgtagccaggaggtgaaccgatcaacttagccactgaatgcggctccatgtactcagacatgtcaaaccggatcatcgaatcctttgaaccaaacagttcataggccagctgcttagccatttcagttttaccaacaccggtaggtccgacaaacaggaatgaaccaattggtcggccggtaccgttgaagccaactcgattacgacgaattgcccgagcaactttttcaactgcttcattttgtccgataacgtgtttttcaaggttaggggccaaattacgaagttgttgttgttccttggtttgaagtttaccaaccggaatttcagtcttctcttcgacaatcttttccatgtcttgagcggtgacctttggcgttgctgccgagtcgacactgccgttcttcttggcattttcaagcttggtaacttgatcacggtagtaagcggctttttcgtagtcttcactcttcaaagcagcttgcttttgcttttcggcactttgaattttttcatcgaccgtgtgtggatcaacggcattgatggtcaaattctttcgtgatccggcctcatcaagtaaatcgatggctttatcaggtaagaatcgatcctgaatgtagcggtctgacagcttaacggctgcttcaatcgcgtcatcggtgtacttaacgtggtggtaatcttcataacgcttttggatacccttcaaaatcttaatggattcctcaggacttggttcatcaaccgttaccggctgcaaacgacgagccaaagcagaatccttttcgatatcacggtattcctttaaagtagtggcaccgatcaactggaactcgcctcgagccaatgctggcttcaaaacgtttccggcatccataccgccttcagcgttaccggcaccaacaatttcatgaatttcatcaatgaacaggatgatgtcgggattatcttgaacttctttaattaactgctgcattctttgttcaaattgaccacggattccggttccttgaaccaaagaaaccacgtcaagacgaataatttgcttattctgaagctttgaaggaacgttgccggaaacaatttcttgagcaagtccttcaacgacggcagttttaccaacaccggcttccccaataaggacggggttattctttgtccggcggttcaggatttcaattacccgttgaatttcattgtcacggccgataaccgggtcaactttgccgtctttggcaagctgggtcaaattaattccgtattgaccaagcagggaatttccgcccgctccgccggttcttggtcggttggggccgccattgttgggtcccattggttgggttggtggcacttgttgaccattggttggatcaacgtttccgccttgcattgcacggaaaatgtcatctaatccaccaaaaccaaatggatcttgagccatattttgagcacctcctgtattacgttgttgattggataggagttgatagcaattttggcaaaggttaatagtttgcttttgcccattcacattagtgtacaaatgaatcgttgctgggttcttatggcaattttgacatagcattaattgctttcctcctttaatatagaaataaaaggacaaggaggatctgttaatcactgaccaactttgacctttgaaattattatacaacatgattatatgtaatcaagtaattgaacttcacttaaattgaaaggagatgagacgttgtggcagaagagaatcaagactacaatcagttgttagaaaagttggaatcaggtgagattgaaaaaatcgaagtcaagccggaatcattcatggcctttcagaccgcatacatgaactttgaccatcgaaagcgggtggttgggtccgcgaccgaaggcggtgtgattacctatgtttatgagagagacgacaagcaaaaaagttcttaaaaaccctgtaagcggttaagtttaaacttgtattttcccttatatattgctattcttaattaagtaaagaacaaatttaaattttgagcatcatcttcaaaatttataatcttatcagaggagattgattaataatggaaaaacgtcaatttaatatcatcgcagaaacaggaattcatgctcgtccagctactttgttggttcaaactgccagcaagttcaactcagatatcacccttgaataccaagaaaagtcagttaacttgaagtcaattatgggtgtgatgtcactcggagttggtcaaagtgcagctgttacgattactgctgacggcgatgacgaaaaagaagccattgatgcaattagcgaaacgatgaaagcagaaggactgactgaataatttcatgaaagagtttaaggggattgccgcaagtgatggaattgccattgcatctgcatttcggttaactgaacctgatttaagctttaaaaagcggagcattactgatgcctctgatgaaattaagcggctttatgctgcgattgatgtctcaaaagacgagcttttaacaattcaacaacgaacacttgaagacctcggcagcagtgaagctgaggtctttaaagctcatggtgcaattttgtctgatcctgaattactcaatcggatcaagtcaacgattgaaaaagagaaggtgaatgccgaatatgctttaaccaaagtcacggacggctacatcaaaatctttaattcaatgacggataacgaatatattcgccaacgttcaagcgatattcgtgatgttaccaagcgggttttaagtcacctgctgcgagtaccgctggttgatccggccttgattcaccacaaggtcattatcattgcccacgacttaactcccagcgatacagctcaattcgtgccgagttatgtgttgggaatcgtgtccgatatgggtggacgaacttctcattcggccataatgtcgcgttcattggagattcctgcagtcgtggggttcaagggccggctggcagatatcaagaacggcgatacggtcattgttgacggatcaactgggaacgtcatcgttaatccgactgaagcccaaacagacgaatatactcaaaagcaggctgactatcgtcaacgcaagagcaagttggctgatttcaaacatcaaatgaccagttcttctgacggtaagcatccaatcattgctgctaatattggcactttggacgacttggacggcgctattgaaaatggtgccgagggaatcggcttgtttcgaactgaatttttatatatggactctaatcacctgcctactgaagatgagcagttcaatgtttacaagacggtgcttcaaaagatgggcaaaaagccggtgatcattcggactgctgatatcggtggtgacaaggatttaccgtatttggatgttccaaaggaggccaatccatttttgggctaccgggcaattcggatgagcctggataagccggatattttccgcacccaggtccgcgcactgctgcgggcttcttcgtttggaaatctgtcagtgatgtttccaatgattacgaccattaatgaactgaaaaaagctaagaatattttcaatcaggaacggatcaaattgattcgggaaaaggttcgggtaaaaccggttaagattgggattatggttgaagttccggccgcggccattctggctgaccaatttgccactgaggttgatttcatgagtattgggacgaatgatttaatccaatacatcatggccgccgatcgtggcaaccggatggtttcatatctttaccagccttataatccggccgttttacgaatgatcaagcatattatcgatgcttgtcatgataataatcttcctgcctatatgtgcggtgagatggctggcgatcagaccgctattcctattttggttggaatggggctcaacgaattttcaatgagcgcttcttcaattctcaagtcccgggcgttaatcaaacggctcgattcaagagagatggtcacccttgccaacaaggcggttaccatggccagcaccagtgaagaagtcactgcctttgttcaccaggccactaataacgtccaatagatttataaataacttaaagaacaagctgttaatgacgttaaaccgtccgttttcggcttgttctttttattcgggtggtttgcaatagcagaactaaaccaatataattacaatgattgtgagactatgcgtcacaccgggtaacggcctgacggcacatttcacgagcataattaatcgatttttattagaaaggggtgtcagccgtgaatgttgggatttttacggatacatattttccgcaggtgagcggtgttgcgacctcgattaagactctcaaaaatgaattggagagacagggtaaccaggtctatattttcaccacaacagatccgcacgtcgataaggacacctacgagcagaatattttccgtttctcaagtatcccctttatctcatttacggatcggcggattgcggtccgcggattatttcaagcttacgaaattgccaaagaactcaacttggatattgttcatacgcaaaccgagttttcgatgggaatgatcggcaaatttgtcgccaaaaacctgaatattccttgtgtgcatacttatcacacaatgtatgaagattatttgcactatgtggctaatggcaagttgctcaaacccgtccacgttaaagaagggacgttggctttttgctaccacctgtcaggtgtgattgcccccagtgatcgtgtattggacaaattgacagattatggcgttaaaagcgagattcggattattccaaccggaatcgacgttgatatgtacgctgaagaaatcaagaccgacattcgcaaagagtatcatatttctccggatacgcctctgatgctttcgattagccgtttggcatacgaaaaaaacatctcagaggtgattgactatctgccaaaaattttgacggaggttccaaacgccatcttaatgattgtgggtgacggtcctgccaaggatgatttgatgagtcaggtgcatgcgctgcagctggatgatcatgttatccttaccggtgaagttgccaacgatcacgtcaatgctttctatcgggcatgcgacgtctttgtttccacctctaaatcagaatctcaaggactgacctacattgaagcaatggctgccggacttccagtagtcgtttcggccagtgattataccaatgggttgttgagctccgaaactttggggcagacatttgagcacgacgatgaatttgttgggattgtgactcattatttaaagcacgaggttaatacccagacacccaaagccaaacaaatcttgaaaaagaaactgactgcgatttctgcagaaacctttggcaaacgggtgattaacttttatcattcagtagcggtggcccaagaattacaagataatgccactactaatatcgactaaatattttgtgaggagtttgtatgttaaggattaatatgttttcaaccgcggataaggtcaagggtcaaggcgtcggcagtgcctatgtggaactggtgagaatgctcaaggaccactttcctaatgattttaaaatcaccattaatagctatgcacctgcggatattactcattaccatacaattaatcccagtttctacctctcgacattttcgaggcgaagagggcgaaaaatcggctatgtccatttcctgccggaaaccttggaaggcagcattaaaatcccccagccgtttaaggcgattttttataagtatgtaattgccttttataagcggatggaccacattgtcgtggttaacccatcgtttattcccaagctggaacgctacggaattaacaaggaacggattacttatattcctaatttcgtcagcaaagccgaattctatgatgttgatgaccaacaaaaacaagccctaagagtcaagcatggatacgatccaaaacgattcaccattttaggcagcggccaaattcaaactcgtaaaggggtgttggatttcgtgaagctggccaagcaaaacccgacgatccaatttatttggacgggtggtttttcgtttggcaaaattaccgagggttatgctgatttggaaaaaatcgtcaaggatcccccaagtaatttatcgtttccaggaattattgaccgcgccaagatggttcaatattataatatggcggatttatttctccttccgtcctataatgaattgtttccgatgtcggttcttgaagcgttttcaactaataccccggtgatgcttcgagatcttgacttatacaagtcgatcatcagcggttattatcttcctgctgctgatgaaaaacagatgaatgaacagctgcaccaactgttattgaatcctaacaaattggcggctttacagcatgaaacgacgattgccagtgaacgctattctgaagatcatctcgccaaagtttggtatgatttttataatcaacaatctaaggaaggttaataatgtcacgaaataataaaattaccctctttacgatggtgataattgggattgcaattattgcatactctttgagggacgttaaattgagtgtgctgatccatgacctgttcaccctgaatccttggtggattttagtcgcctttctttgcatctgtgcctatttattaattgagggcgtaattacaaaagtcttggtgtccaatcgcgttgaacacttcacgtttaaggatgctctgcgggttccgctggttgaacagctatttaatgggattaccccgttttcatctgggggccaacccggacagttgtttgtcatgctgcagactgggattgatggcggtcgggcaagctccgctctgttgatgaagtttgtggtgtatcaaggaatgattgtgatcaacttttttatcagcttggtcattggattccattttgttgcaaccaaattgcactttttggcgctgtttgttttatttggctttttaattcatttatttgtcatcgttggcttactgttgataatgtattggccgtcgtttaccaagaaactttcaaaattactttttcatcctgtcaaatggttcatcaaggacgagaaattttattcaatgcgtgaaacgatgtattccaaaattgataatttgtttgaggaaagcgtcagaattgggcgtcaacccaagctattattaaaaatcgttgttctcacattttttcaacttcttttttattacctcatcccatatttcattatgctatcgctcggctatacgggtatcaacgtgattatggttaccagtttacacatcatgattgtgatgattatttcgttgttcccaattcctggtggttctggtggtgccgaattcagttttgaatcacttttccatagctttatttcgagtaacagcaaattggtattggcaatgattatttggagaattttaacgtattactttggaatggctgctggggcctgtgctttattagtcaaaccagataaagttgatgatcccgataaccgcattaaatagcgggcagggaaacatttggaggaacaggaatgttaacggataagaaatatcgtttttcaaatcttttaaacaccagaattggcttctttttgctggttgtcattttgttttgtatcaagacgtatattgcgtatcaaactaaatttacgctgggcgttaaaggcggcatgcaggaattcttgctggcagtcaaccccatcccggcggcactattgacattgggcattgccctttattttagtggccggctgtcttattggttgatgatgatcatcgatactttggagagtatctggatttttgccaatattctgtactaccgtgagttttccgactttctttcgttaggtgtcatcaaaggatccggcaatgttcaaaataacttggggaagagcctggttgaaattcttcacttcagtgacttttttgtttttctagatgtgattattttgattgccttgttggcttttcatgtgattcgaattgacgccgctccatttaagaagcgttatgcatttttgattacggtcgtttcttttctcttgatgggtggcgaatacggtctggcaagcactgatcggtctggtttgttgaccagaaccttcgacaataattatattgttaaatacttagggttaaacgagtatgccgcttttaatgcataccaaacccaaaaagaatccgctacccgatcaaaagccaaggccagcgatatggatagtattttgaaatacttagatcatagtcgggccaaggccaatccggcttattttggcaaggccaagggcgagaacgtcttcattattcatcttgaaagtttccagcagttcttaattaattataaagtcgacggcagggaagtgacgccccacctgaatgcctttttccacaataaaaataccattggttttgataacttctttcaccaggttgctcaagggaagacttctgatgccgaaatgatgttggaaaattctctgtacgggttacctcaaggatctgccatggtgacatatggtgcccagaacacgtatcaggcggcgcccgctatcttggatcaacgaggctacacaacagctgcattccatggggatgttcccagcttttggaatcgggacagtacgtacaagtcctggggatatgattatttcttcagctctcaatattacaagacgaagccgtcttacagtgtcgggtatggtctcaaggataagattttctttagagatgctgccaattatattcaacagctgcctcagccgttttatgccaaactcattactttgaccaatcattatccatatttgctggataaacaaaatactgattttcctgccactaagaccggggataaaacggttgacccatacgttcaaactgcccattatctggaccaggccttcgcggaatttatgaattatcttaagcgaaccggtttgatgaagaacagtatgattgtcgtatacggtgatcattacggtatttccaataatcaccgcccggccatcgcccagctgctccataagaaatcgattaacaattatgatttggcacagttccagaaggttccgttcatgattcatgcacctggccttaagggtggggtcaatcacacatatggtggtgagattgatgtcttgccaactattttgcatctgttaggcgacaagaataataatacgattcagtttggaaccgatctgttatccaagcagcatgatcagcgggttgcattccgggatggcgattttgtcacaccgaaatataccaaggttggcagcgacgtttatttgactaagacgggcaaactgattacgccaaatgccgctcaaaaacggcagttggctagcatccaaaaccatgtgacaacggaattatcattatccgatcgggtcatctggggagatttactcaggttctacacacctaagggattcaaaaaagttaatcgcaaagatttcacttaccaatataccaaggctcttgataatttaaagcaggcccaaaagaaagaaccaaccagcattgaagcaaagaacaatggtaaatcgactatgaatttgtacaagaccgatgcacctgaattgaaataggtttgcgaattaaaagtggaacagagatgttccacttttaatttggattaaaacaagtcatcgtttgtgataaacagtcccgatcgttaaagttcaattgatttgaaattggggcttgacgaattgatcaaacttcgatatatttatagatgctgtttttgttcgtgaccaaccaatatcaattcaatcaattgagaaagttgttgacatgaaacaacagtattaaaacattaaggggtaacggtcagagtttgagactttgatcgttaccctttttgtattctcaccatgattccccaactatggcgctaactgtcgccttttctgggtcgaatcgttaaaataatccttaaattcggtggtgccaatgctgattatgctataatttttattagaagattgtagatcggagcgcttattaaatgaagttcatggattgggtcaaacaacaattaaatatatttgtgtcgccacgatcccatcggcaatcaaatcgtcggggccgtcgccgggactatcaccaacgaaagcgttggcagtctgcacaagtcgacccggataatagtgcccaaatgccagaagtgggtacttcttccaatcaagacgcggttgaagaccaagcggatgggctggtcaacgactcctcccctgcaccttctcaagccgaggagaccattcaaatcaagtctcaagtgaccttcttttatctcgatgaaaataacgatccaatcaaaaagcctgacattttaattggtaacgatggtgagcgcttttcccttcaacttcccagctttaaacaatattacctggtctcaattgataacttttcgacttattttgccgataccgatcaagaagtcacattccgatatgccctcaaacaagggttaccggtcctagcctattatttggacattgataccggtgaaacgttgcatcacgtcacaatccactccggtaaactgggtgagccttatgacgtttcagctgcggatatccccggctaccgcgtcatcaatgatgtcggtcccactcacggccactttgacgaccgcacccatggaatgattttttattatcgacgaacccattggcaaactgtccaaccagttgagtattatgtccgtctgaaaaagcgacacgctgtcttggaccaaccaaatggccatgcgttacaaaccggattgccggccaatgttatcaccaagatttttgcccgcatcgaaacgacggacaatcaaagctggctaaatattggcggttttgaatggataaaaaatgccgaccttgaacccagtgacccgccgaccaatcatctcgttccaccgattacgaaaacttccaggaatccggtcatgctgtttggaacagttgatttcgtggctggcaggccaattgcagtctttgataaaccgtatggcaccaatactggaacagtggcagacggacaacgggtttcaattaaagcccgaattatcgatgatcagggcctgatttggtacgagctggccgatcagtcagtcatctttagtgaatatgttagaattgattcttaatataatcagattgggatagaaggggatttgatcccagactttaagtaaaaatcgagttattcctgttttgggaatgactcgattttttgtttaaatgaccgggatcagccgtttgccaggtaggcttggcaagcacgctggccggggccgcaagtttttgtcaatataagagcggtaatcaaagctgacggctacttaaaaatggcaaatatgaaaaccgatactagcgcaatcatgcaaacgacaaccgcaaatccaccaacaatcattaatttttccaaccgattctttgccggatcccgcttttgccgttgctcctcaacatcttggccatccgtgaaggccacaatttcagcataagttctcaggtttttgcgtttctttattcgctccacttgagatgcgctaatgaacatgaccgcaaaacagatgatcggcaccaaaataatcaacgtcgattgctcaaagtaaataactaaaccgattgacatcgcccccaaagcagctgcgattagcatcacccatgtataagctgacattgccgcattgactttcttatcagataatttagctttcatcgcttccaaatcccccttaatgagttcatctacagaaacgccaaataaaacacttagtagtaaaacattttgaatatccggatactgtttgccggtttcccaatttgaaattgtctgcctggaaacatatattttagatgctaattcttcttgagaaaaaccacggacttctcgataagcccgaattttattaccaatgtccatttcctcaactcctcatccaaaagtatacctgaatgttgggacgatttctgtcacgttaacgtatattgtcaccaaaatgctcaatgaaaagtcaatgtgacacctcgtgcggcgggttgtccaacgcaaaccgcaatctcaaagtttgccttttttatataaacacgttgtatctagcgcttcgctttatcaaccacgacctaacatattggacaaaaaagccggtgaacaaatatgttcaccggccagttcttcttcacgagaccaaaagagtgaaattgttccctcgttggtcgaaacatgctccgaagctaatcagcttggtcttgtctctaaagatttttatccatattaaacgtcaacttggacagtgtcagtcccttttcaatcaattggtgattgaaatgctcagtggcaattcgcatcattttgacaacttcatgattttgctcggtcaagtagctggtcaattcttcacccttcagtgcctgactttcatcaatcgcgctttggacgtggcgccgcagttgttccttcatgtcagttaagaagtcgacatcatcttgaataaattcagaataatgggattccactaacatcgataacttgcggtacatccaataggcgctgacatcatcgcaatggaccggcgtgttggcataagtatcatcggtatccgttgcattagcaaagaatggcacatatggtgaaaatgccggtaccccaaagcacagccacataattgcattactgttatttttgagatcattacgaatctgcaaaacatgtgaattttgggtccgattcattgaaattggccgaaacagcgtcttagtgtcctcatggcctttactaaacggatcatagggcgtttcgttgtaatgagagctcaaaatgtactcaacatcttcgacactaattttatggtccgtatgacagatgaacggcaaatttgaggaagttggtgactgctcaatttccggattcaggtatttctggccgaaccaaacccgaggcgtattgtaatgacggtccttttcgttatctgttccaaagatgtgacggaagttaaatccctgcttgtcagtgttcaaatgatacttctcgacaaattcttggatgccgtctgaatacatgaagttgtctggatcatcaaatttcacctgttggatagcaacttgattggcggcaatcgcataggcgtcatcaggaattcgttgagcaacccagtgatgaccggtaacaatttccatgtaccagacttcattgttatcgctaaacaaaaccccattaccctcgggtgatccatactgcttgattaatttaccaagatattgaacaccgtctctggcagaatcaatgtaaggcaaaaccattgactgcaacgagtcctcggctaagccgtctttgaccaatggatcaaaagccagcgcccgttcattcccgtagacactttcagtggcactcatggcaacgttcttttcgttaaagccactttcggcgtagacaccttccttatcaacttcaacgttgggcgtcaatgagtaacgataagcctgcttgggcagtggtgccttaaaaccattttggttggaagcccactcaccggtttggtgatcattggcgggttcaacatagaaacgttggggtgttagcggcaaaaatgtatcatcatttctggcaatcatcgttgagccatcgatggaagcttttttaccgacaagaactgtggtgcatgcggacaaatgtttggaaaccatcatatctcttctttcaaagttaaattatagtttggcggttaatgtaacatcagggtacttatccttgaaccagcgaagggcaaattcattctcaaataagaataagggattgccggcgcgatcctttaccaataagtttctggaggacgacatcttttcgtcaagttgatcaggatcaatccagcgggcaatcttatggcccattggatccatattaacctcagaattgtattcgttcttcattctgaattggaaaacttcaaactgcagttgaccgactgccccgagaatatagtcattggtggtataggattggtaaagctgtaccgccccttcttggaccagttggtcgattcctttatggaatgatttttgtttcatgacgtttttggcagaaactcggacaaatagttccggagtaaactggggcagcttttcaaactcgacttttttcttaccagtataaatcgtgtcaccaatctggaaattaccagtatcatataatccgataatatctccggcaaccgccgtctggacgttctctctggtattagccatgaactcggtcacattggataatcgcagtttcttctgtgtccgataaaggttaacgtccatccccttctcaaactcaccggagcaaacccggacaaacgcgatccggtcccgatgattcgggttcatgttcgcttgaatcttgaagacaaaaccagagaaagtatcgtcatccggcttgattaagtcgccttcttcagtcttgtgggcacttggcgccggtgcgtatttcaaataagcgtcaaagaacgtcttgacaccaaagttgaccaaggctgacccaaagaataccggagtcatatcaccagtcgcaattttaccctcgtcgaattgattaccagccatatccaagagttcaatggcgtctttggcgtcttcaaactgttcgtcttgagcgagttgatcgttgttcaccggatcattattatcgtccaaatcaacaatttctgaagactggttgtttttttcgtgattataaagttcaacgtgatggttatagcgatcaaaaattccagtcaaggtcttgcccatgccaattggccaattcatcgggtaggcttcaatgcctaacacattctctaattcgtcaaccagatccattggttcccgaccatcacgatcgagtttattcataaaggtgaaaattggaatgccccgcatcttacagatttgaaataacttcttagtctgcggttcaatccctttggcggaatcaatcaccatcacggcagagtccaccgccatcagtgtccgataagtatcttcggaaaaatcctcatggcccggggtatccaaaatattaattcgtttgccaccgtaatcaaactgcatcacggaactggtaacggaaatcccccgcttctgttcaatttccatccagtcggatttggcaaaattaccggtctttcgggcttttaccgttccagctgagcgaacgacgccaccaaagagcagcagctgctccgtgatggttgtcttcccggcatcggggtgggaaatgatcgcaaatgtccgccgggtactgtcttccttttctaattgttgggtattcatgtttacttcctttcaggcgagtcaataactaattaattttaacacgttttcgtcgactctcctagaacccgccttaatttcattggctgcaatccaaaacaaagaggatggaaacaaaacatcagctttgttccatcccctctgtgatgtgaaattacataccactttcaatttgatgcatgacgtagttaaccactttcaatgaactcaagccatcgttaatcgcacagaagcggttatagaagttcataaacttctcattggctgacatatcaggatgcgccaaagcatggttgatttcggctaacagctgcttggagttttcagcaattttgccaggcagatccttctcatagttgagatagaacccacgtagttcctccttgtacaaatggtaatcgtaagggtagaacaaaattggccgcttcaggtaggcatagtcaaagaagactgacgagtaatcggtgatcaataggtcggataccaaatacaagtcactgatgtttggataattcgaataatcgtaaacgaagtctgaataatcggaaatatccaaagcgttggaaatcaaataatgcatccgcagaattaagaccgtgtcatcgccaaacgacttccggaagtcatccaaatcaaacggcaactcgaaggtatacttacctttctcggcaaattgattgtcccgatacgtgggggcgtacataaccacctttttatccagcggaattcctaactgctctttgatagcatcgatatcttccggttgagtattgattaattcatcgtttcgcggatacccaatctttaagatttggttattgaagccaaatgccgaacggaaaatctgcgttgagtagtcgtttggtgaaaccaaggcatcccaacgattggcttctctgacaaagttcttgtgatatttaacggtggtagtcccaggcattgaaacgttttcgatatccaggcccagctttttaagcggtgtcccatgccaggtctgaatataggtcacatagttaggcttcttaacccaagttgggaagcgggcattactgatccaaaattgggatttttccaagacccgaacccacttgttggttcgcctaatcacgtaggcaatctgattttccttacaaaacttcttctgagaacgatcaatggaccaaatcatattaataccaggatacaacgttttgaagaccttataaatggcgtacggactgtcactaacctgacggccgccaaagctttcaaaaataatcgtggtgttatcgtatggtgaatggcccgacttgaacaggaaccgcattctaaccaggttcagtttgtcttgaatcatcttaatgacatcaataatggtgccggccttgccgccagctgcacccaccttctggagcagagaggcaccagcaaattccttgaccaggatgccattatcatatcgtttttccaaagtgatctcacgattaccagccagttgaatatcggttgattggccggctaatgacttggagataattaatcgctgcttgatagatttgccgttcaactcgtattcgatgaaaagttcaccaactgaattttggggaatgtcggttaacggaatggcaaccgtaaacatcccttcaaacagctttttggtcactgggtattccagtgtgccctcggtcgtgtggtttttcaggatgatgcgttgatttttgattaacgtcccgttgatcttgttataaccggtaatttccaagttttcatcggttaagttgaccgaattgatcatgaattcttcatcggattggtgagtccgaatgttaaacaacgccattccctgggcatcgctgttgaattggtaataactggttaattcaagttgatgacgatcacttaaatattcactttcaacttgaatcacatttttgttggtcaagttgttattgatgagaaaaatctgccattcaaattcagtttgatcctctgattggaaatggaagtcttgggcatcgatgttgacccggataatattgtgggacagcactttgctgatcggcttcatgatcgaggccaagctatttttttcgacaaataaaacgtaagcagtatctaatgacaccgcaacgtctaataattcaaattcaaggacttgtttgcccttcttttgatggacacctgataatatcgctcgcaatttaatttccccttaataattaaagattcgtttgcctggcaggtacttggatgcatcgacaatgttgtcgatatcgatgtatgtccgggcgtcttcaatattcatgtttaacaagacttgatgataaaaggcattaatatcgtcgtagcgatggtaatcgctgtatgataatgctttggtgaaggtcgacttgccttggccttcgtaggctgtcagcatttcgtcctttgaattagacttgtcatcttgaatctcgcttaattcctgaggggcagcaatcgttgaacttggggtgacgttataactcaccttttggtccttcacgtagttggtaaatcggtaaaccagttcacctttagcattcagcagcaagctttcagtcagcgcatcatcaacatatttttcaatcccaaataatcgatcagcatcatcgtaactgttgatttggctgatccggctgcttttgtcaaagtaaagggtatgtatccgggtgttgtcttcggtaaataaagtttcagcgacgatgtttccgtcagcgtcaatgtatctggtcaccggcaatttgccctggtgcgccttaaaggtctgtaatccagacagatccggatccatgaaatcggcggcctttagactcacaccgtcatgttctgcgtaaatatctgccagtgaaattaagcgcacgctaggagttcccttcggtaggtcaatcttggaaaattcacgctttgcctgccagatttcatcaaaatcggtcattgccaacaagacaaccacctgatactgattattaattaacgctaacagctgtcgtcgaaatgtcgctttgcgaattccttgaatcgttgttgccaaaaaaattgctcgtcccatgattctcctcctgaataaaaacgaggctggaacaaaacatgtagtcttgtcctcagcctcatttgaatcttgtgtgctacacatttgattgtgggtattggtttggaatgtccgtggcgggaaagcccgtccagattggccaagtgccgggataaccagaatctcagatgttaagctttccaatcctcggtatccgttaagcctaaatcttctttgatcttggtggttgaaataccttccgttcttgggaggtatacgacttcgcaataatcctttaagaagtcaaacttccctttccagtcatcacccatcacgaagacatcaatgtctcggtcctggacgtcgtgaattttttgatcccagttggtttctggaatcacttcatcaacgtatttgatggcttcaagaatgtatttacggtcttcgtatgacgtgtatgctttcttgcccttctcagcgttaaactcatctgatgacaagcacactgtcaggtggtcacccaacgcctttgcccgcttgagcagacgaacgtggcctttatgcagcaaatcaaacgttccatacgtaattacttttttcatagaatctcctacttaatcattactctgaatgtgaactaaaataaacacatcttaaatagtagcataatcaccgacaacgtcaatatttattaaagattattaacgtttttgtgttattccagttgataaatattatacatgtgcacaaccactactttgaccactgcgtaaagtggaacagccagaatcatccccatcagaccggcaatgtttccagcagccagcaagatgatgatgatcgtcagtggatggatttccagggattttccaatcacgtttggatagaccaggttaccgtcgatttgttgcacaatgaggaccacgatgatgttataaaccacggaccacaagccaccgtgtgaaaacgaaacgatcagtgccggggcaattccgatataagggcccaagtaaggaatgatgttgcagatcccggcaatcacacctaacaataaggcgtacggcgtgccaatgatgacatagccaatggccgtgaaagtaccgacaaacaaacattcaatcatctgaccggaaatgtatttggaaatggtgtggctcattttgcccagtaaatccatggtctgttcacggtgacgttcaggcaggaatttcttaatcgttggggctaatcgatagccgtccttaagcatgtaaaacaggaccaccggcacagttacggcgataataaccgcattggcggcagcagaaataatgccccccaagccgttggttacgccattaaaaatcgtttcagcatatttattgacatttgccgacaacttattcgtcaaggtcgtaaaatcaatcttcttgagcatctgctgagagttcatgtccttaaacagtttatcgaccaacttctgaccctggctggcagcgtcaggaatctgattggccaacgtaatcaactggtttaaaattttgggaataaagacggttgcggctaacgcaaccaatcccaacaagagtaagaacaccaacgtggttgcccaggttctggtgatttggtgcttcccgaatttgattttggtaatcaaattgacaattggattgagcatgtaaaataaaatccccgccaacaagatgggaataaagaccgtggaaaagaagatggcaattggcgaaaagacaaagttaatcttcgtagagatccagatgatggcgaccacaatcaatatttctagtgaccaaaacatcagtggggaattttttaatcgttcgaacatcgaatgactccttaccttgattatttgaatagtcataacagatcatgataattgcttataacggtaattgtaccatacatcgtaaaaggaaatgatggggctttggagatttttattcaccaggaaatcattcttggccagcgaaaaacggccacaataaaaatttagaaagtcttcaatggtatttactattgaaggcttttgttttatattgaaatagtacatatttttgggaaaatgggtgaaattatgaaacgatacagagcttaccggctgagcctcggctggcagattcttattggtctattacttggtgtcttttttggtgtgattttctacaaaaacaataccgcgataacggccatgcagaatattggaaccatgtttatcaacttgattcaaatgattgttttaccgattgtcgtttcatgtttaacagttggaattgccagtatgggagatattaagaaactcggtcgagttggtctcaagacgatcatctatttcgagttgatgacaaccatcgccatcgcccttggaatggttgtcgcaaacgtcctacatcctgggacactgattgatattcactcgctgcacggatctgatatcagccaatatatggcaaccgccaagactgcgcagcataccggtatctgggggacattgctgggaattattccaaccaacatcttcaagtccctagcaaatggggatatgatgccagtcattttcttctcagttttctttggtttaggaattgccgccattggtgaaaagggacagattctaattgacggtttgaatgcagttgccgaagtcatgtttaaagtgactaactgggtcatgcatgccgctcccatcggagtctgtgccttgattggagttgccttggctgaaatggggattggtgccttaatcccactcggttattttgtggcaattgcttatgtcacgatggccgcgttcattctcattattatggggatcgttgccaagatctttggctttagtatttttgatctcttgctagtcattaaggatgaaattgttttggcattttcaacggctagttctgaagccgttttgcctaagatgattgagaaaatggacaaatttgggagtagtcaaggaatcgtctcgtttgtcattcccacaggctatacttttaacctggatgggtcggcaatctatcaatcgattgctgccttgttcctcgctcaggcttatcatattaacctctcgatcggccaacagatcactttgctggtggtgctgatgattacttctaaaggaatggccggggttccaggggcctcatttgtggttttgctggcgactatttcgaccatcggggtaccagttaccggactcacttttatcgccggaattgaccgaattgtcgacatgggtcggactgccgtgaacgtggtggggaactcactcgctacggttgtcattggtaaatctgaaaaagagtttgacgaagagaaatccaagaaatatattgcatcatttaaaaagaaaaaacctgtcgaagaagctggataggttactaagataaaggccgggacaaaactgaatgttttgctccggcctttttgtattctaacgacaaattaaaagccgccaacgaatttacgttgacggctttataatgttattggtcgataagatagcagtcatctttcaagaatcagtttccaccggattcttggaggtatggtcctcataattactattattatcgctttatgtgtggcaatttaacacgattaattgatttctccccaattagtttcctaaaaggtgaagcgtttttcgactatgagtagtcgaccggacacaagtacgccagtaccaacgtgttcgagaccaccgagaaattgcattaaccgaattcccaaaagttgactcatctaaacaaacaaagtcgggaaatttcttgtgatgcgcttagctgtaaagctagtaagcaagaaacaaaacgtttagagtcgtcaaacaattattcaattcgggaagatcggttacaacaatttctcgttaacgattaagtcgtgagagagttatcacaaccgggcttcccttggtagactgatgcttcgtcgctcctgggtctataaattctgctgtcataactctcacctcttcaaagttttatttggtaatgaaaagtgtccagccgttcaacgactggacacatcaaaaatacttctcgccagtcgttgagctttagcactatgtgatgtagttaaaaattaacagctacgttagtccaagccttactttgacctggacagctgactcattggcgtttttcgacgtttctgagcagtagcattttccacataggagcctcacctaacagctttattcatttttcattccacaagttataatatcacgtcaaccaattatgcgcaacaattaggcttacatatccattccaggaatattcagatcttcaaccttaacaccacgctctttagcaaaggcattcatcaaagtatccatatccattagcttgtattgctttggatgatccggatcataaacctcaaattgcgccatcatgccaccatcttcgtgttcaataatgtggcagtggttcatgaagacgcctagatgattgaaccaaactttcagccgaacggtttcgccagggttgacgccgaccgtatctttcaagccattttcatttggataaggcgcatggccgtttctggaaaccaccctgaactgtgtcccgtgcatgtggtaggggtggaccatcccgttactcatatcgttggtgttgctgatgtcccaatattccacgttgccgagcttttgtttgtcgtcgatccgctgcatatcaaatttcttcccgttcatcatgacttcttcatccattccagacataacaaccttgtggactggtgcacctggggtgacatccggatcaggaatgtccaccagatgatcaggcaaggtggtattgtccggcgcaaattcatggattctaaagcgcatgattggcacgtcgtcacagaacaaggagacttcatcgccgggcttgtattggccaaagtcgacgataacttccgcccgctcagcacacgtgagcatcaggtgggtaaaatcaaccggttcagggagaatgccaccatctgaagcgatttgggtaaatttcaaatcatcactaaaatgcagccgccattcacggcggttagcaccgtccagaaagcgtaatctaagccgctgggttgttacatcaaagtatggattaatggtcccgttgatcatcgcagtcggcccctgcacgccgtcagggtcatagtcagccatgtaatcccactgattgtcttcatggaagcgacgatcctgcaaaatgacgggaatgtcgtcaaccccataatttcttgggaatggtagcttggcttcaacgtcatctttgacaacgacagccgtagctaatcccttccaaacatgttcggccgttgctgggcatgggtgcgcgtgaagccacaaggttgccgcaacttggtcgcatttaaaatcaatgtgggtgctttcacctggataaaccggcgcgtggcagccaccatccgtgatgggaccggggacgtttaaaccgtgccaatgaaaagtggttagttcaggtaattcattttttaaagtaatatgaatcattttgccctttttgaacaaaatggttttaccaagtaaatcagtattatagccccatgtcttggtcttcttaccaggcatcagctgtgcttcaccggtttgggcgatgaccgtgtagtacatgtcagtatcggtctctttatccggcttaagcaattccggaatcttcagcggctgctgtggtgtcttaggttcctcaaggggaacaaagccaccgtcatgggtattgtaagctggttcgtcaaaaaaataatctgtgtaaacttttcgttctgacattttatccgcatcctttgtttatattggattcaatttaataatactactaaattagacgccaatacaggatttgtggcataatggaaatacaagaggaggtggcactgtggcagatgtagtatctttcgacaagttagatgagacagcaaccaatcaagcagtggaagactttatcgatttttaccttcgatggttcaagaaaaatgatttggaaattttggctgagtacaagattgactattacttggctgacattaaccattacattttcgaaaacaagtccttcacgccagaacagatgagaaaagatttactggaacaacgcggaaacgaccttaaacacgtgatttcagtgatcaacccagagtatgatgagaacgggagcctgaaggcaggttcttgggatcaatggtaccaggcaaagtttgaaaaagttcctgatcgcgactaggcttttgaatatacattcaattgtgaatttgctattattgagctatacagagtagtggggagggattttcatggctaaaggaaagaccgaaaaatcaaagaaaaagcaaagttccaagaaattgcaatataagactgacgttgatgtccatcaaatggttatcaacaaatcagtcatgtctttgaaggtaccgacgattcttgcacaaaaggaagctcaggggttgttaaccaaggccattgatgacgggattaccccttactacctcaagcaagaaacgattgaacgattaggtggcattagtcaccacgaataaaacagcgggcgttcattacctggtctggtcgactgggactgatggacgtcgggtaacgaatttcacaaaagaccagcacgctgagacgtctagtaatctcaggtgctggtctttttttgtggtagaaaagtgttgcaggttttcctgcatgaatctatggtacttaaatcgaagaagtgatctcacaagttgttttttggtgccatcttgtcgacatgcagtttataaaggtcccggttgagcaatttttcgtcggatgccactgcaatcgcggttgtcgtatctccaaccacgttgaggacggttcgaaacattcctgagaaccagtcaatgccggctaaaatggcaatgctttgcaatggcagtcccaaagttgggacaacgattgtcaatgtaaccaggccgccgccgggaacgacaaccgttcccaagcaagcgatcactgacagcaggacaattttgaccatcgacattggtgaaacagacatcccgtaaagttgggtgagcgtcaagcatgacagtgacaaatacatcgccaaaccattgctgtttaacgccatccccagcggtaataccagttggctaatcgatttttcgacccccaaccggttttcagcatcttccatttcaattggaagtgaaattgctgacgaagttgttgtaaaagcaactaaaataattcttgaaaagccgcggaccaatcctctgagcggtactttggcgtaccagctgatgaagctaaacaggacaatcaagaaagcgatcgagcccagcccaaatgcggttaggaacttgagcaggggcaggatgactttaatcccgctggtagcggtgacccaggccatcaaggcggcaattccgatgggggcgagcttcatcaccagcatgaccagcttgacagttagctggttcatctgtttgacgaaactcaacacttgattgaatttgccgtcagtattggcacggttcaaaacgatcccaaacagaattgcgaaaataatcacctgaatcacattacctttggcgagggcgtcaaaaatgtttgtcggaaagaaatctaagacagtctggctaaaactagtccctgccttggcgaccgttgcagatgtgctgaccgaagccagcttgatgccgctgcccggattgactgcgtagccaatggccaagccgaggactgctgcaattaaggttgtgatcaagaaccacatggcagttttgccacccaatcttcccagttgatcggattttaagctgcccagtgcttcgatgaccgccccgaaaatgagcaggacgaccgccatttgaatcaggcgaaggaaaatatttcccagtaattggatgccggcgatttttggaccaaatgccaatccaagaagtgccccgccaatcatgccgattccaatttgtgcagttatactaatgtgtttcaaaatggttcccccaaacttaataggcttgttggtggaggcttgcggctaacagctcaacgccgcgaagtaaatcttcttggctggtgttctcagctggcgcatggctgatgccgttgatgcttgggacaaaaatcattgtcgtccgagtgtgcttagccatgatttgactgtcgtgaccggcaccggaggccagctgaatggatttgaagcccagttgattagcaattgcctgattattctcgagcaattggcgatccagccgggtaacgtcgcttttcgcccagcgattggccgtgctggtaatccgttggttgccaggagccgtaacggtttgctgaaggagtcgttcaaattgatccaaaacggcttcatcactattccggcagtcaaccgtaaacgtgaccaggccggggataacgttggacgtattgggcgaaatgtgcatttccccaaccgtgaaagttaaatccggattcaatcgacgggcctgttctcgcagggcgacgatgagatccacagcgtgctgcagggcatccgctcggtcattcatcggcgtggtgccggcgtgattggcgatccccttaacggtgacggtgtaccggcgttggccgacaatgcttttaaccaagccgatttgtaaaccctggtcaattaatcgcggtccctgttcgatgtgcagttcggtaaaggtgtccggtaaatccggcagttggtggtgaacgccagcgagcatcaacttgataaccgcctgttttcgagcatcatcaaattgaatgccggcaggatccttcatcgtcaaatccacctgttggccggtatagtgcttcgaaccggtaaaggtatccggaaagcggctgccctcttcttcgctgaatgaaatcagtcgaagcgttttctgcggacggccgaattctgttaccagattttcaattgcctgaaggccaccaagtaccccgtacaagccgtcatattgaccgccttgcgcgacagtatcaatgtgtgagccggtcgcaatgactgcttccggttctgtggttcccggcatatccagataggcagtcccaaagtcatcaacgcttacctgaaagccaagctcaagcccccatttgatgacttgtctttgagcctcaacccaggttggtgaatagaccagccggttttgaccggcttcgttggtcttaaattggttgattgtcgctaaacgatgtgcgagttcagttaattgggttgttgtcatatgaccgcccctattttaccgcgctgacaccagtaagtggcgatgaggcaaccgccccgtgttcgatgacccggcctggttttgctaagtaagctttgcggcctgcttcaacggccagcttgaaggcttcggccattaacggaatgttgccggcggtcgccattgaggtgttggccatgacagctgcggcacccatttccatggcttcggcagcttgacttggtcgaccaatgccggcgtcaacgataattggcaggtcaatttcgtcaatcaaaatttggattaagtctttggtggacaatcctttgttggtaccgattggtgcgcccaaaggcatgacggtggcagctccggcatcgaccaactggtgagcgacattcaagtccggcagcatgtacggcatgacgatgaagccttcgttagccaaaacttcggttgccttgagggtttcgtagttgtccggcatcaaatatttcttgtcgggaacgacttccaatttgatgaaattgctgccgcttagttcacgggcaattcgcgcagtccgaatggcttcttcagcgttggtcgagcctgacgtgttgggcaaaatggtgatgccttcaggaatgtagtttaagatgttttccttgccggtcttgttgcggcgcagggccatcgtgatgatttgtgccttggcgttattaatggctgaatcaatcaaatcgtatgaatattttcctgaacctaaaataaatcgagatgtgaaggcgtgtccgccaatcattaactcatctttttcgtttgccatgaataaatcctcctcagatttctgtatctcctaaaattaaccgggtaatcatattggcttcgtgaccggccgcaatcatgacccgcggtgccatcaagccctcagcccccatggattcaccgtcaccagcgatgtataaattcttgcggggatgcttggtggtaatcgtgttggaactgtgaatgccggccatcccggtgcccatcacaattggcttgtcgggatagaactcggatgcggcatccagcagcatcgccttggcagcagggttatcgaacgcttcagtgatgatgtcagcgtcttcgaacaattctttgacgttgtcatgagtcactttagtttggtgaatttgaatttccacgaacggattaaattcctgcaggttttgctttaaggccacaacttttggcatgtccacctgactgagtttaaattgctgacggttgaggttactgagctcaactgtgtcaaagtcaatcaacgtcaagtggccgacgccaatccgggtcagcgcaatcgcgatattggaccctaaaccaccggccccggcaatcgtgacgtgagcggcagctaatttgtcagttgaccccttaacattgcgttctttcatgccgagataaacgtcatcgtaactcattccttgaatttctggttcttgcatgttgtcaatcgactccttttatatcagtgagcggatccaagcggttaggagtcggagtgtaagtctccttcaagagaaattcccggttttggaatttatcttgaaggtgcttacaggcagactcctgcttggaggagctgtcctaatcagtgagcggatccaagcggttaggagtcgccaagtaggctaggcgtttcacggccgtcggattgtaagtctcctcggaagtaaattccctggttttggggatttgcttccgaggtgcttacaaggagactcctgcttggaaccaccatcctaaccgccaccaacaaacgagattaactccagtttgtcgttgtcggcaattttagttgtgtcaaattcagagcggtggacaatcttgccgttctgttcgacgacgatgttttcaattggtgcttctctttgtttcaagaactcggtgattgtttgaccaaccataccggattcttgttcaccgttaaccatcaccatacaaaaagacccctttcttcagattccgaagaaagaggtcagtggatgtcttttcaacattaagttcgattcacagaaaagaaaaaccttcttttctgcaaaaagaaggtttaaggtcaaaataaattcaacattaaattcgctcttccttcggcagtacaaactacatcaggttcgatgggtgtaatctcagccgtttcaggcaccccagacgaaatattcaattaggcttgaaactttgctcaagctcataatctatttataaccgcttacaatctgaaagtcaagtgagaaatacttctatactttttgccgaggttcatttacactgatggcaaatgagaaaatattggaggaaatgattgtgaaactaacaaatcgaccactctatttggtgacggaccacaccggattgactgatgaacaattctttggcgcgattgaagcgggtgtgcaaaatggggttggcttggtccaacttaggcaaaaagagggcagtagccgcgaaatttttgaacttgctctaaaggtaaaggccattaccgatcggtacaagattcccctgattattgatgaccgattggacattgctcaagcggttgatgccgccggtgttcatcttggtcaaagtgatttgccggtagacatcgctcgccgaatcttaggacccaagaagattatcggtgcaacggccaagacattgaagcaggctaaagcagctgaagagatgggcgccgattacctgggaaccggagccattttcccaaccacgacacacgttaagaccgttcatacgacggtagaaacccttggtaagatcaaacgattggtggatattcccgtgtatgcgattggcggcttgaaggccgataatgtcgaggcaattgatggtgcccacgttgatggggtggctgtggtttctgcgattatgaaggctgccgatccggcgagtgctacccgggagttgcgggatgcggttgaggaagctattgggtaaattatatcgggccacgaatagtgttccagaagcaacatacattcagcaaatactgcagaaggaatctaaacaatcttttggttcattgttgacttaaaatgtatttcttgcaggatcataagtgacagctacaattggcctcatttagaatttaaattccagcttaagaaaccaaaaacagctactcgtaatgagtagctgttttatcgggctctacaatatctgttgttggtaatagatttttatctataaaaaaggcagctgcttcgcatagctaaactaccgaacgatccgtactttggatcgtttgttaatcgtagctaagcggaagcacctgccttttcttcaggttttagaaataatattcagaaaatataaacaatctaagattagtttgtcgcatcaaaaatccaatttctgtgatcacgtttcaacaaatcttgcgaagcttgaggtcccattgacccacttacataatttggaaaatctgctttttcactatcccatgcttcacggatgacatccacaattcgccaagcctgtgcaacttcatgccagtgcgcaaagttggtccgattgccatcaagtgcatcatggatcagtttctcataagcctctggaatcttagccttttcagctgctgttttatgatagtcaagatgaattggcataataccatacgtttgcccaccatctttgacattcaaatcaagccgatacccttgatccggttcaatatacagcgtcaaaacgttttgatctagcaaattgctatccgcatctgttgagtcaaaaatattggtatccacatttttaaataccacattgatttgtgtcgatttacgtgcgagccgtttcccagttcgaacataaattggtacaccagctaaagtcttattttctgtttctagtttcccggaaacaaaggtttcgatttgtgactgttcatcagtaccctcttcatggcgataatctgattgtgtgtgatccgcatcctcaccatattgccctcggacaaagttttgcaaagcctcttctttcgaataaaccttgatattttgaagtgcctctacttttcgatcacgtaattcagaagctgtgtatttacttggtttttccatcgttaacaaagaaataatttgcaaaatatgattttgcaccatatcccgtaacgctccggccgtttcataatagccagcccgttcttcaactcctaaggattcagctaaagtaatttgaatattatcgatatgttctttattccaaagtgatgaaacgatttgattaccaaaacgaagcgcagcaatactttcaatggcttcttttcctaaatagtgatcaattcggtaaatctgatcctcagaaaacgccgctgaaatatcgtcattaagctcttttgccgttttaagatctcggccaaagggcttttcaatgattaggcgattataaccatgatcagttattagcttttcggacttaagatgtgcagcaattgtcccaaagaaccgaggtgccattgccaaataataaattctatttccttgtaaatcatatttttcatctaacttatcggccaaatttctcaaagccacataatgctctgtatcattcacattgtgtgattgataataaaaatgactggcaaattttcgggccaattcactgttcgtccgatctgactcatgaccatcatctgcgacagcattcatcacaacttcatggtagtgatcatccgtccatggccgtcgagccgttccaataacagcgaaattgtcttttaaataccctttttcatacaaacgaaataatgaaggatacaattttcgatacgctaaatcgcctgttcctccaaaaataataaataacgcttgctgtgtcattctatttgccccactttcacaatatctattctttttaattatgaaacttttgtacaaaatacacaacttataaaactccaaaaaaaatttgaaactaaaaaagtttcaaatttttataaaatatctaattatttatctgagtcatctttaactgaatcatcagttggttcctttggctcttcaacatcagcagttttgtcatctgttgctgaagcaacatctgtatctgcagttgctgctggttgaacagcttcaacatggtcgacacgcataattgcagtacgatcaaatactaagtaaataccgtcacaatctaatgtcaccgttttagcatcagtatcaaccttatccacaacaccatgtaaacgaccaattgtcacaactttatcgccaacttgaagtttactcatcatttcttgatgcttttgttgttgcttcttttgtggccgaatcatcatgaaatacattaatccaaaaattaaaacaatgaaaataatgcttcccataccactaaaacctgaatttgctcctaataacaatataaacacctcattttctttatcctaactgtatcaaaaaataccctttagttccagtaattttagaaattctttggatgcgcttgattatacccatattcttcaaaaaacgcttctttaaattccaataaattatcatcctgaatagcctgacggacttgtttcatcagatgaactaaaaaatacgtattatgaatactagttaatcgcaagccaaatgtttcttctgttttcatcaaatgacggacatatgctctagtaaaattgcgacaagtataacattggcaattatcatcaattggtgtaaagtcacgcgcatacttcgcgttcttcacaaccaagcgcccgtgcgatgtcatgcaggttccgtttcgcgcaattcgcgttggcaaaacacaatcaaacatatcaatcccccgcattacaccatcaatcagtgaatccggtgaaccgacgcccatgaggtaacgtggtttgttttctggaagcattggcgtcgtgaactctaaaactcggttcatttcatcttttgattctccaactgacaatccaccaattgaataaccagggaaatctaaactaacgagatctttggcactttgttcacgcaaagccttaaatccagctccctgcacaattccaaacaacgcttgccaatccggattctggtgagctttcaagccccgttctgcccaccgactcgttctttcaactgaatgtttaacatactcgtaactttcaaaaaatggcggacattcatcaaaactcatcataatgtctggtcccaaatcattctcgatttgaatcgctttttcgggacttaaaaacatttttgcgccactaatttcattccgaaaatgcaccccttcttcagagatatcacgcagtttagctaatgaaaacacttggaaaccaccagaatctgttaaaattccttttttccaattcataaacttatgcaggccaccagcttctttgacaatatcttcaccaggacgcacccaaagatggtaggtattagaaagaataatatcagcaccgatgtcttccaattcttctggagacatggccttaactgtcgcctgtgtgccgactggcataaaaatcggcgtcggaaaagtcccatggggggtctcaatttcgcctaaccgcgcgccagtatgtttctcagtttttatcaaatgatacttaattgcaggttccacagaaattctccattcttctctttatttgataaacatcgcatccccgaaactaaagaaccgatatttttcttcaatggcgtgttgataagcatttaaaatcatgtcacgacctgtaaaggccgccactaacataactaatgtagattttggcaaatgaaaatttgtgatgaaggcatccacaacttgccacttgtacccaggttttataaaaatgtctgtccagccactatctgctttaatctcgccattaaatttggttccaattgtttctaaagttcgaatcgaagttgtccctgtcgcaacaattcgacctccatttttacggacttcatttaaagttgcagctgactcttcactcaaccgataaaattcactatgcattttgtgatcttcaatgttagcttcatcaaccggacgaaaagttcccaacccaacgtgtaaggttaaataaactaatttaacccctttatcctcaacttttttgagtaattctttggtccaatgtaagccagcagttggtgctgcggcactaccactttcacgtgcataaacggtttgataacgctctggatcatctagtttttccttaatataaggtggcaatggtgtttctccaagcttttccaaaatctccataaaaataccatcataatgaaattcaatttcacggccaccatgttccagctcttttactaccgttgccttcagcaacccatcaccaaattcaataattgtaccaactttagcgcgtttagccggtttaaccaaagtttcccactggtctcctacatcattgtgtagaagcaacacttccatgtgggcacctgtctctggctttataccataaattcgtgcaggcatcacccgcgaatcattcatgacaacagcatccccagcatgtagttgatctaaaatatcataaaaatgtttatcttctaagatacctgttttgtggtctaacactaataagcgcgactcatcccgctccttaattggcgtttgcgcaattaattcgtgtggtaaattataatcaaaatcatcaactgttaatgtcatggtgattctccttaattagttttattttgagctattcccaagtgtgcataacccttttctgtcactacacgaccacgcggcgtccgattcaaataaccaatttgcataagataaggttcatacatttcggcaattgtatccgcttcttcaccaatgtttgctgcaatggtgccaaggccaactggaccgccatgataaaagtcaatcattgtttttaatatcttattgtcaatttcatcaaggccttcttcgtctactcgcaaaaactgcaacgatttcgtgacaatttgctcatcaattgccgttttatcagaaacttccataaaatctcgcactcgtttcaaaaggcgattcgcaattcttggcgtccctcgtgaacgactcgcaatttcatgtgaaccttggtccgtaattttagtgttaaaaatgtcagcagagcgtttcacaatttcagttaaatcctctactgtgtagtaattcatgtgagcaacaataccaaaccgatcacgcaaaggtgccgacaacaacccagcacgcgtagttgccccaattaacgtaaacggtggcaatggaaaatgaattggatgagccgttggaccctggcccaccacaatatcgacaaaaaaatcttccattgcagaatacagcatttcttcaacaatcttgggtaaccgatggatttcatcaataaataaaatatcaccaggctgtaattcgttcagtaatgccactagatctccgggtttttcaattgccggaccacttgtcgttcgaatatgtacagccatttcgttggcgatgaccatagcaagtgtcgttttccctaaaccgggtggtccatatagcaacacatggtcaagcgactcttcacgttgtttagtggcctggatgtaaactgataattcatgtttgattcggtcttgaccaatatactgatctaaagttgctggacgtaacgatttttcaattgaggcttcttctgaattctcattttctccagaaacaagacggtcgtcatctgcatcactcatccaattcaccttcctccattattttttcatcagtaacttaagtccactacttaaatattgatccgttgtcatcgctggatctgcttctaaatcaggtttaatttttgcaatatctcttgttgcatatcctaaagccgtcaacgcatctaacgcatctgccaattgatgattaccaataggcttagctacagttttcacaggatcgactgaatttaatgtcatcttgccctttaaatctaaaataatttgttgtgctgctttaggtccgatcttaggaaacttcttaagataggccacatcatcattattaattgcagcaactaatccagaatgatcttcatttgccaaaatcgctaaggcacttttaggaccaatgcccttcactaacaataatttttcaaaaagttctttatcttctgcgtcaaataaaccataaaggctaattcctgtatccgaaacggcttcatgcacatagattttcacttgtttttcgtgactaacttcataacgataagggttgccaacaaaaagtttatatccaacgccttgaacttccaaaaccacaaattcaggtgtcacttcagtcacatagccaatcaaatattcatacattcaaattctccccattatccaaactaaacatatgtttgctttttaatcattgtaccataaatcaactttattcttgttcttctaatggttgatgtggatcttgaatgcgtttaaacatttttttcatatcttcattggaaaaatgtactaaaactgggcgaccgtgcgggcaattaaatggattttcagcctttgataaatctttcaataattggcgagcttgttgatcatctaaatggtgatttgctttaattgctcgtttacagctcatcatgatagctgttttctcacgaaacttggcaactgtcatccgactgtcattaagaacataatcaatcatttctcggatagtatcttcttcctgtccttctttaaaccacgttggatgttgatggacaacaaaactatttggcccaaatgattccaaatggatgccacaactagcaagcacatcttctttttgttgaattctcaacatgtcacttgtggaataatctaaaacaatcggcaccagtaagttttgcgcatcgtccgaaacttctccaatttgttgacgatagtattcataattgatacgttcctgggcagcatgctgatccaaaatataaagtccgtcctcagattcagcaaataaaaatgtgccgtgcatttgtcccacgtatcgaagtgccggaaaccgcttagcttctttttgtggtttatccattcccatcgttgggtcgcttttatctgcatttttaggctgtccgaatggcaatggttgtggttcttcgccatattttttttgaaactgttgcaaagatggtgtatgcaattccgtctcgtgttttatcacaattggtttttttccattttcaggaagcgcagtaaataatttgtcacttgaactcgattgagcttgttttaaattatcagaatttaaagcaggtttagaattgtctatatagcttaccgatgcttcgttcaaattaaactgcaactgatccgtgttaattttttgtttggtttttaaattttgaactgctgaaggaatcaaattttcctttgcaagcacaccatagatcgttttggagattagtttttggagctgcttttcttcactaatccgtacttcttgttttgctggatgcacattcacatcaaccaacaatggatccattttaatgtttaacacagcaactggatacctgccaaccatcaatttagatccgtaaccctcaattattgctttatttacctgaaaatttttcacatagcgcccgttaatcagcacggatatatattgccgagaggcccgtgtaaactcaggcaaacttgtataccctgaaatctcaaagtccacatcttccgcactaaatttcaccattttgcgggcattttggacaccataaattccggcaatgacttgctgtaaattaccccgccctgatgtccgtaataattctcgaccatcatggtttaaggtaaaagcgatttgtggataacttaacgctaaacgattcacgatatcagtaatgtttgcaagctcagtttgaggagacttcatatacttcaagcgcgccggtgtattgaaaaacaagtcctgaacactaatatcagttcctttcctcaatgccgacaatgtcttatcaacgagcttgccacctttaatatgaatctgggtaccagtatcgtgcccggttgacgtctgtaaaatgacatcagcaactgaagcgatactaggtaaggcttcgccccgaaatccgagtgaacgcactttgaatagatcctcacgggtactaattttactggtagcatgtcgttcaaacgccatcgacacgtcatcagatgcaatgccatccccattatccacaatttcaattgattttaatccagcttgctctacaagtatatcgatctgggtactgtttgcatcaattgcattttcaactaattctttaactactgaagcaggacgttcaactacctctccagcggcgatttgatcagcaagaacatcagaaagttcatgaatttttgccattttatctcagctttctatttgttacctaatttcttttgccatttatataactggttcattacatccattggtgtcatagacatcaaattagaatttcgaatttgggcgagaacttcctcaccttgcggattagctggttccgtttgaaataatgctaactgttcatcgacttcactagtcttatgattctgcttttcttgaacatcttctgcaggttcttctactttttttgacttaatttctgcattaacaagtgtttgatccgtatctttatttttaatctctaagcgtttcaaaatcttatcggcgcgtcctaacaattcttcaggcatccctgccagtttagccacatggattccgtaagacttgtcggcaggaccgtcttccattttatgcaaaaaaactaagtccccgtccttttcaacagcgccaacatggacatttttgagcttggttaaagtctgatccaaaacggttagttcatgataatgcgttgaaaaaagtgttttagcatgcacatgattatgcacaaattcaataatagcctgtgccaacgccattccatcataggtcgctgttccacggccaatttcatcaaacaaaatcaaactctgtggagttgcgttttggatggctcgattagcctcttgcatttccaccataaaggtactttgacccgcaattaagtcatcggcagccccgattcgcgtaaagatttgatcaaaaattggtaatgtcgctgattctgctggaacaaaacatcccatttgtgctaaaacgactgtcaaagctaattgacgcatatacgtacttttcccggacatatttggtcctgtaatcaataaaatatcaacattgtctgccattttaacatcattaggcacataactttgccgacccattactttttcaacaacaggatgccgaccaccaacaatatcaatactatggtttttggttaaggttggtttaataaagtgatagttttcactaaccaccgcaaaactctggagcacatccaatgtggcaacctgtttggccaatttttgtagccggtcaatcacttgtttaatttgttcacgaattttggtaaacaattcatattcaagcgttgttgatttgtcttctgcttctagaattagactttctttttcttttagcgctggggtgataaaccgttcggcatttgttaaagtctgtttgcgttcatagcgcccctctggaacgttacctaaattagtctttgtgatttcaatataatagccgaataccttgttatacccgactttcagatttcggattcctgtggcttttcgttcggaagcttctaattcagccatccactttttaccattggtcatggcatctcgatacttgtccaattgcgcgttatagccatctttaatgacgttaccttcagtaactgaaatgggcggttcgtccacaattgagcgttcaatcaaatcggcaatgtcatccactggatctaatttagcaagcaatagaagtcccagaaataaacacgaaataagataccacaccttattattcttgctaagattcataataaaccttcccttgtactgctatagttttctggacatcgacactttcattaccaatgagagattacaataaaaaattggtcatatttttagcgtccattcacagaatcacgtctacaccgtatcaaagtaacttgcagacatacattaaataaatataaaaagcatggtaaaaatattacaatcactaatttcagtaacggaccgtaccatttttactatacttttgggattcctatgaaaccaagagcaacttatatttatgattatctaattgttctatatccttgtattaaaactactagtacaagagggattgtaatccaccaatctctccgatataccaatgaaatacctaagaacagtgaaaataaaataaacacataaaacgatggttttttataaaaaagggggttcatccgcaaataccaactccttgacaaataccatgtgctaatcccggaaaaaagctatctgaattccgaggcttatctctacgccgaatacaccccgccgtatagcaatgtccgccgccaattatcaatttagcctcctcatcagaaagcacctcaaatgattttaattttttcataaagaattgctcctatactgaaatttggtaccaaatttcagtataggagcaaacgccgacaattgatgacttagatgcggtttcaactacccaaccaattttcatttaccgttctgattgtcactcctcggtcggcaattccaaagcgcttgaactagccggcattgatcaaacaaccccggatcccaaaggcggctttattggccactttgctgacggccggccaaacggttacatgaaggaagtcgcggccactcaactattaattcgggccaagtcagctcaaagcttcgctggcgacgtttcaaacatggtcactagttccactcattatctcgaaaacggcattgtcgcaattggcgaattaatgggccgaatgaagcccgctgactcctatcagctttaccaagccgccgctaaggaaggttttaagcccaaagtggccatttattacgtttatgatgaagtggctaacaatgccactctcaagccaaccaatgatgaccagctccgaattgctggcatcaaggtgttcatggacggtagcatctctggtgaaactgcctataaccaagccccctaccccagtgaaaaccgtggggtggcactgacagatgccgccaaactccgccaagccatcgattatgcccgtcagcaccagctccaagtcgccgctcatgcaatgggggacgcggccattcaacttgttttagctgtcagccatgatttgactccctggctagccgatcggccatcaattcgaatcgagcacgcttcgattttaagtgatcagatgctgaaagaaattaacgatgccacgatgacctatgcattgattacccaaccgattttcttttttgctgaagacgaatcttatcgtaagtatctatcgcctgcccagtttaaactgatttaccgtgacaaatcaatgctggcaaccagcgcggcctttgcgttaagttcagacgcaccatgcaccccatgggccgaacctgatagcccatttgttaatatttacgcggcagtcactagaaaagcggctaacgatgatatcgttaatcctgaagaagcgctcacaattccagaagcggtcttggcctatacaaaatggccggcaaagattggcggcttcactcataacggcaccttgcaacccggaaaggcagcagattttgttattttggacagagatatttttacagtaccagttgagcagttgcggcatgtcagggttaatgaaacatggattgcgggggaactcgccttttcaaactaatttgtaatatgtatatataacaaaagccgaagacaattttgtttcggcttttattatacagttataaaaatattattgtttaacaataatcgatacgaaactttagtgttagaaaccctcagttgcaagtcatcgaatgggggtgatggcgagtagtacgattattttgcaataacaaattgtttgttagcggtaatatagttaccattgcttaggactaatttgctagtggtgccactctgaacgaggtgagtgactttcaaaacagtcccctttttaagatgcttaactttgtttttcttagtaaacgacttcttagcgtactcattaatccctttgctagctaataccgtcactttctttggtgcggactgatagtagagtttagcaacatacttgctattagctgtaatgtagccttgcttcgtcttatacctcagtgcaccatttttcgaagaagcttcccccgtcacggtaaaggttgctgcattggtgcgaccacgcttagcatatatcttaacgacgtgcttaaagttaacgtccttataaacccgaataccgcgttttgcataaaccttgaaggatttgaaagtctttgtcgtttcagaaggcttaggtgttgttggcacacttgacgtatcagtacttgaggcagttgagctgcttgaactacttgtactgcttgaactacttgcacttgatgaactagagttgcttggcgttacaggggttactggtgcagctccattgatagcaagcttaaagctagccgtgaaggaaccatcatcgtgctttttagcagtcaccgtgaccgttttttggccaacgtaattggcattaaccttcagttggtaactgccatctgtctgtttttcaacagtgacatcttgggcatcatcagtcgtcacattgaaatcagccgcactactatcagacatcttaatcccgaaattggcagtcttaccggcagctaaggaacttggttgattagtaaattgaactgtagctcgatggtcttgtgcggggagatcgtagaccatggaagtcaaggtatgattagcattcgatgacggtgaagcataaccgccgccattaacaatcaaaatctggttattcggaagtggggttagtgaccgcgaataagcgccacccattggcgtattgacgggcgtccaggcgccaacgccattatttttattgattaaaacgttgccattactactattggcaacaacggtcccgtcatccaaaacggttgaatatggcgaaccaccatcagttaaatatgttcctagctcagtcggtttccaattgaagccatcatcagaaattttgtaatatgaccccccggaaccgttaacactacccatcatttcataagtcatgatgtacttaccgtttggcatttgggaaacggtagccattccaggtcgagcagcggatcgggtatcagcgacgtcatcaacttcttgaccccaatcaaccccattggtagaaacttggtgagctaacaattggctatggtcgggcttatcgcgttcatctgaataaaacgtcactagcttatgatcaattacttttaaaaatggttcccaaactggtccattaccattggtcgtcgtcgtagcggtaccacccttggcaaccgtgctgacgtacgtccaactgcggccatgatctgtactcttataaagatcaatcgaagtcttgctcaaatcacttggaattgagttccctgcacagagaagcgtgcctgcaggcatatcaccaatttgttctggtaattcatataaaaatggttgataacgcattccccagccatgttgggtatcctttacttcactaatcttgttccaagtgccaccatgatcagtgctttcaaaaattttcaatgacggcgttcctgatgtgtaattttctgatgtcgcatacagccggccattatacgatgggtcgctttggtgagtggtaaccattcctcttccataaaggaaattaaccccttgagttcctggcaactggtccttagttgctactgtcacaactgaattatcactacttgccccaccgtcagcggccttagctggttgagcagtaatcgtacttaaaccaaggactgtgagtccaactgccccaacgacaattttggttattttcttaacaacggaatgcatataattcctccttcaataatcaacaagcgcttacattttcttcacaacaaaagggaatgcaacccgccactttatcatgacaagtccatccacctatttagttgccattaaatcccaaatggttagtctaatcgctatgctttcggcttacctgcttcgtcacgttcaccagcttgaagtggattttctttcttcaaaacaagtgcagcaaagatagtcacaaccgcaacgattgcaccaagaatcaagtatgtgtggtggaaaccgatggaatcgtacatgctacctgcaaatgctgagaagatgaagacagatatctgtttagcaaagttcgacgccagtgcgtaaactgtggcgtagacccgaacatcgaaggctccggcaatgtacttcatgattgaaacaagtaccaaaggcatttcgaatccggctaacaaacgtaagaagataacccagattaagcttggtgacaatgctgatccaatgatccggatagccaagatgaccccataggcaatcaaaccatttcgtgaaccgattcggttaataatccaaggcattgggaacatcagtaagaattccaacccaatttgggcggttgtcatataactgtatgcctgagttccggcagcggctgtatcaaagaatgacttgaagaagataatgaattgttgatcaaaaacatcataaatagctgaagtaccgatgtagaagattgacagataccagaagttctttaatttgaaaattttaccaatcatgcttaagtcaagtgaattagatgtatcaccagcagcagaagcattatccatatcaaccttatcactgaacaaaagcaaaccagtcaggatagtggctgaaattgtacatgcccagaagattgagtttggatgccacaagaagatttgaccaccaacaaatgaagcaaccattccggctaaagaaccacccattcgtgagtgaccatattcaaagccgttagctaagctggcacgttgaacgtattgttcaataactgaaacaccaccattgaagatgaagcaaagatagattccagtcacaatagcaactaacatcgagttaatgttcatcagtggcataaatacccactggaagtatggtccgattaacattgcggcgatcgcaattgtaaatagcaaattctttttaaataaaagcttatcagaaatgacaccgaatgctggttggaacaaaagtgataatccagccatggccgagaagacgaccccagcttcggcaccattcatgtgaccaacttgttccatccaaagagtcaaataaccaaagataatctgccacatgaagaagtaagtaaaatgggtaaacggaaatccccagaaatgcttaccctccttcttttgtggcgtttttgcatctttttgcataagaatatgcctcctaatataaagtgagtgagcggagcaaagcgattagaaagcggagggtaggtgcttacatgcagccttctgctttgcgcagttgaattaaatctttaatcatagttataaggaactggcttgccaaaatgaggcgtcccgtcatcattccaggtaaatgcttgaaccttggtatgacggtttggatcatataatgggtcgcctttaatttcggtataatcgcgacaatgataaaccaaaatatcagttttgccgtcctcggcaacagtgaatgaattgtgacctgggccatattgatgagttgccatgtcactttggaaaacaggatctttcgacttagtccagttacttgcgtccaacaaatctgcatcatcgggaacacttaacatacccattgcataatgctcgtcggtagcgcttgcagaataagttaagaagtaacggccgtttcgatgaataattgcaggtccttcgttaacccaaaaaccaatcgtttcccaatcaaattctggtttcgtcaacatcactggctttgtcttgagcgtccagggattttccatttcggcaatataaatgttggaattaccacgaattgccggatccttttgggcccaaacataataaagtctatcatttgcttcaaagcaagttgcgtcaagtgagaagctgtccatgcctgtttcaacttgaccatgttcaaaccagtcatcttcacttctcattggatcttcggcatcacattcgatacagaacattcggtgttggaacatcccattctgatccaaggcagttgtttcagcagctgcaaagtagatgaaccatttgctatcaatgtaatgaatttctggtgcccagatcagccgtgacatgggaccgctttcatgcttgcgccaaatagtacgtggggcagcatgagccaatccggctaaagttttagcccggcgaatctcgatcaaattataagcagggactgaagcggtgaaataataataaccgtcagtgtgcttgtaaatgaacggatcggctcgttgaacaatcaaagggttgatataatcagtcaatgtaaactctccttttcactacgtagttttgtaagctccttgtgcacatttttataatatggcctgtagaaaccgattacaatggtttttgtgagtggtttggatatttttgacttaaataaacgtttttgttagtattaacgggttaataaaacggttacaatttaaagatcaataaagttattgatcaaagtgttttcattgctttaatatcagctctagtagtgaatgtatatacaagaagtgctatcttatttttagggagtagtgccaaaccagagctcgtggataagcgacgttggctgccagctggtaatttaaactggtaacaccgacacatgcacctgcaagttctaaccactttgaactgctcactttttaggagttaaaaattatggaactagatatctctcaagattctctaaaggtttataaagcgttagccagcccagtcagaattaagattattcaatcattgtcaactaagcgaaccagcgttcaggagctatcaaagcaattgcatttaagcagtacgattgtattgatgcacctaagtaaacttgctgaagccggcattatcggctttgaacgtcatgggcaccaaaaagtatcttaccttaaagtcgacaacattaatgttcatttcccaagtaccatttatccggcgttcgccgaatatgatacggctgtgccagttggtcaattcaccaattactcagtaaccccatcttgtggcttggctggcaaaaacgattacattggcaaagtcgataacccaacctactttatgagtccagatagaattaagactggcatgatttggtggaccgatggctttgtcgaatatcaatttcctaattatttagaagaaaaagataccttggagatgctggatctttcaatggaacttgggtccgaatttcctttttccaacaacgtttggccatccgacattactttttatatcaataatgtcgaaattggcacgtggacaagccccggcgatttctcagatattcgaggtaattacacgccggcttgggtgcctgataacgtcaatcagtacggccaattaaaagtcgttcgtttaaccgaccacggcagctatttagatggccaaccgtttaccgatgtctcgatcaatgatattaattggcacgatcccacgatcactgttcgatttgctatcaaggcagacgccaagcataaggggggctgcacgatctttggcgctggctttggtaattatgatcaggatatccaaatgaagttattttatagttaatcgataaattacgtagagagggtagtactcatgagtcaaactgataaaatgcgagaattcattttaagctatttggagacccaacctaatcaagttaatcttgcaaccgtccgtaaactaattggatatggcaagaataatgattatagcgcgctaaataccttaaatgaactgttggtgatggatcaaaagcatgaagccattctcaccgcaatttttgacgttgattttgtggatggggttaagttgttcaacaaccaggctacccgctggctgacccctaaaggaatcaactatcttcaagaactgaaacacggctccgccagccaacctactatccagctatctaccaacaataaaaatcgggctgctcaaaaatacgatggttatcttgctaaattaatttctgcaaaggcgacaatgcaaactgaggcggaccaagttacccttcaagaattttcattagaccttcgccatttactcactgataacaagaagctcgaacgtggcgccctcaataaattctcaccatttgtccagcgtaattggcaagaactctcaacgccgatgacccctatttttatggaactatcccggcgattcttgtttgataagaattacgatgcctgaatactgacgctcattataaaaacgccacttttatttggaaaacaaaataccctcggcaaaaataattttttgtcgggggcattttcaggtttatgacgatttatttgaattgtttcaaccactctaagcaaagcgggaaccacttggcaaaatgcttatctgcccggtcgcggttcacaattgccgtatattgattgcctaagctaaagccgtggccgcctgaaccgaagacgtgcagttcgaatggcacttccttttcaaacagcgccgttgtgtatggttggatgtggtcaacatacggtgccagcccatcttccctggcgccaaagataaagattggcgcagtatctgtggtgacgagctttgaaacatcctcactttgaatgccaattttttcatccaaagcttgattaatcactggatagcccaagatagcgaagtgagcgtagttgttagcctcacaagaataagccgctgcgagttggccgccagctgaaaagccgatgatgccaatattttgaggattgactttcaaatcgtttgcgtgtttaataatgtagtcaaacgccgttgtaatgctttgcttagccacttgataataggctccgttaccagtgatttcttttagatacttgtaggttcctttagcctgcaaaactggtaattcactcccaatgacttctaatttattatccattttatgatctcctttgctttgctaatctcacccgttgtttaggtttacttttggctttataaaagtgaacctaaacaacgggttcaccaacccgcaataacgtgcagggcggtaggcaggttctaatcaaaatcaaaacttaatttatgaccgtcaagttttagcttggcgtcaaacgactttccttttttactcttgaaaccctttaatttgctggtttctcccttggtgaccaacgctttaattgcggtcttactgagggtcttactgctccatttcttgggcagggtaaagtcttcgccttgcttaggttcgcgatgaagattaccaacggcaaaagcaagaacgtggactgaaagaaaccgagtgggaaatgacgaaaaagcagcggcaacaccaaacccggaaccggcatgaagatgggggtatgcacttgtaagaacctgtctagtatcttttaagaactatcttcaggaaggccaatacaaccatttgaagactgctgttaagggcacgttcacagtttttccaaagtcgccgacatttgtctagccaactccatgaacgttcaacgatccatcgttgcggtaacaccgtgaacatatgcaactcgttgcgtttagctaccgtcgtcttagcattcaaaatgagcttcacctgatccgcaaagtcattgccagtgtagccaccatcaaccatgacatgctgaaccagctctaaattttggctaaccaaactaaacatagccaatgcacctgaacgatctgatacattagctcgtgtcacgagaatggcttgtggtaaaccattaatatcaaccgccaaataaaaacatgtggtattttggttgggagagtgggtcgtcgattgggggagacaactagcaggtctggatcgtgtccgtcttaaagcggttgctagaataagcatatcgcatatctaaataacgggttgtcagcatgctaagtgctaaggcccattataaagtcacttagcaactgagtaactttataatgggtattggtggggggacacacgtgcttcagcacagatttaatatagtagaaaaaagattgcgaatcagaaatgatccgcaatctttgcatttgtttattaatttagagtggctttttagtaccagccattagcaagccagtgactcttggcgttgctccatgaaccataacgtgaagcaacataactgttagcaacacgttcttggttggcagcggagtagtcaccgtttaagtatgaagcacttaattggtacttaccgatgtattgaccgttacgagcagaatatgaaccaccagattctttaccagcaatccaagccttagcagcactatcagaaccattgttgctatagtttgatgttgaactagacgtttgagtcgtcgtctgagcagcaggtttgctagtttgtgtttgacttgattgggtctggctagcttggctcggttgagcttgagtttgactagtctgagctgatgattgtgtcgtggtcgtttgtcgagtcgtctgtgttgaagtcgttgaggttgttgaagcagctgaagacgtagcttggctagttgctgattgtggtgcagcacttgtagcagcagaagtcgtggttgttgtagtagtaccattgacttcaagcttatcaccaatgaagattaagttaacattagctaacttgtttgccttttcaatggctgaaactgaagtgttgtgagcttgggcaattgctgaaacagtatcgccggccttaacagtataagtatcagcgttggcaaccgttgttgagatagcgaataaagctaatgcagcagttgatgataatacaaggtttttgatcttcataataattaatacactctcctataatttgcgtgtgttcgattatttacatatattttctattggtcgagcagttgatgtctcaaccaatcaacagtgactagtataactagtgagtgttgcagtgcaataatcagaacattacgtttttagggggtgcttgtaatataaggccgtttttgtaatgaattataatatttggtagattgtatcaacattactagaataaaagtagcgggataaatatttcacgaccaaatagtatctaaatctatacgttcaacaccaagcaatcacacaccacaacacagcacaccgtatagaccctttaaaacgtcttctaagcgattttaaggtgcattgcttaattatatatggcgaattgtcaaactaagtgcaacggtttgtcaaaaaatacttcatatggggtttcatagtttaacactttgcgaggacgttgatttaactgcttttggcagtgttcaacgtcctgttctgtataattatcaatatctgttcgcttgggaaaatattcccggattaatccatttgtattctcatttgttccacgctgttcaggcgaatatggatcgggccaatagacagtaacacctaacctttcgctgatttcatcaagatgaagaaattcggtcccatgatctggtgtaatagaatgaacaaattctttaggaatggcccctaacagttcaactaagcctttatttatctcctgcgagtccttttgcacaacctttttgataagcgtaagccgactaagccgatcgacaaccgttaaaaggatggcgtgacccgttcgaccaatcacagtatcaatttcccagtcacctatacgttgacgctggttgataaaaccagggcgctcatggatcgagatatagtcggtctgtacttctcgatgtcgtctagtattctttgaatgccgagtccgatgtttatgtctgagatggcgctgaataccggtatcaccacgtgaggagtacttctcacctaaattgtgttgatagatatgacggtaaattgtgttgtagctaacacaccattgatgttccttattaaagcgagcggtaatctgctctggtaaccagtgcagatctaagatgtaatgaacaatttgacggcgtaattgtggatggctgtctaatagccgcttcttgtgacaattctgccgcttttgatgatagtcattatctgctttgcttggggaataattacctgcacaacgttttaactcccgtgaaatagtgcttggatttcgccccagccgtaacgcaacagcccggatagataaccccttagttcgtaaaaacataagtatttcacgttcttttatagtaagatgtttatagctcataccggatacctcgaattgtttgatttggtcgttaaacatattctacccggtatgggtttatttttttactttgtgttgcatttcaattgtaaattcgccctattaaaaaaattctaatcacgttctaaagctggagacttttaaaaaaatcaaaattttgatatagtggattatagtacttttaggtaaccaagaagtttttgaacgccttatgaaggttgagtatgatgaaattggttggatatggtgctaatttcttggtttagaacaaattggtgaatataaaaaatgtaaattttattttgactcattcatagcgttatacaccatgtctacccaagcgcgtggcgcatgttacccagattattattccttatgaataataatctgggtaacatgctaatacatggaggtgtatgttggtagaaaaagttaaagttaaaaatgtaactaagatttttggaaagcaaatatctctagcaaaaaaattgttgcgtgagggaaagtctaaagcagagatcctttcgcagacaggttgtactgttggagttaatcaagctagttttgctgttaatgaaggtgaactgtttgtaatcatggggctgtctggaagtggaaagtctacgattatccgaatgatcaaccgcttgataaattcgactgatggggatattgaaatcgatgaacaaggtgtgatgggcctcagtaaggaagaattacgtcacttgcgccaagataagatcggcatggtttttcaaaattttgccttgtttccgcataagtccgtattacaaaatgcggcttatggattggagcttaaaaagtttccgttagatgtacgaaacaggaaagctcatgaagcattgacactagtcggcttgaccgggtatgacgaccaatatccagatcagttatcaggcgggatgcagcagcgggttggtctcgcgcgcgctttggccaatgatgccgagattctgttgatggacgaggcattttcggccttggatccgttatatcggaaagaaatgcaggatttgttattgcaaattcaagaaaaaatgcataaaacgatcatttttattggccatgacctgaacgaagctttgaaattaggggataggattatgatcatgcgtgatggccatatcgaacaaattgataatccggaagatattttgactcacccggctaatgattacgtagaacgcttcatcgaaggggtcgaccggacaaaggtcctgacggcaagtagtgtaatgacgcaggcccaggtggttaatattggaaaggctggaccacgggtggctttgcggagaatgcgagccaacgatatctcttcaatatacgtggttgataatgacaacaaattcgtgggttttgccgatgcgcatgatgtttcggatctgattaagaagggcagtgaagacctgaagtcagtccttaggacagacgtgcctaagacaagtgtggatatgccaatcaatgcattgattaacgatatttcgaaggcagcaattccttatgtcgtgttggatgatgacgatcatctactaggcatcattctacggagttctgttttggcggctatcgctggggaagaggtgagtgcttaatgaatattggacaaatacctttagcggaatggatcaactcaggtgttgactggctgagtcaatttaccggatttttttatagtgtgacgatctttttccaggtaatcattgacggtattcaatgggcttttgacttcttgccgcaatgggtctttatcttggtggtcttagcactcacgtactgggttaaacgaggacaaaagaaaattagtttcatggtgtttgaagttttggggctgttattgatctggaacttaggatactggcgtgatatgacccagaccttgacgttagttttgtcgtctagtttgattgcaatcgttgttgggattccacttggaatttggatggcaaaaagttcaagagctgagatcgtaatcaaaccaattcttgacttcatgcagaccttgccagcgtttgtttatctaataccggccgtttcattttttggtatcgggatggtaccgggggtgttggcttcagtgatttttgcgacgccaccgacagtgcgaatgacaaacttgggaatccggcaggtgccaagtgacttgatcgaggtagcggattcctttggctcgaccagctggcaaaagctaatcaaattacagttaccactagcaaaaacaacaataatgtccggaattaatcaaacgatgatgcttggactttcaatggtcgtgattgcatcaatgattggcgcccttggtttaggaactcaggtttactttgctgtggggcgtaatgatgccggggcaggatttgccgcaggaattgctgtggttattgtagctattattttggatcgaatcacacaatcgttcaacaaaacatccaaataaagggggaatgattagtttgaagaaaagaattctccgttatttgcaaatggccacagtgattatatgtttgacagccatagttagtgcttgtgctaaaccagctgaatacgactcacataaaaagttaggaccgcaaatcaattatacgattacagggatcgaagctggtgcgggtgaaatggctaatacacaaacattgttgtcaaaatataagttgaaacaggctaactggcagatcatgccaagttctacagctgcgatgattagcacgttatccaaggcagttaaaaataaacagcctatcgttgttactggctggcagccacactggatggttgctaaatattcgttgaaatttttaaaagatccaaaacatgtttatggtaatggtgaatcaatgcgcaccattacacgtaaagggttggaaaaagataatccaggtgctactaagttactaaagaatttccattggacaatttcaatgtcaaatccagtaatgctgaacataaacggtggcatgaataagcaaaaagctgtcaatcagtttattaaaaaccatcctaaacaagtcaaagcatggacagcgggggtgccaaacggtcatggcaaaaaaattaaattagtttatacaccatatgactatgaaattgcggtaaccactttagtaacgactttgttgaagcaaaaaggatataaagctacaatgcaacagttagacgtgggagttatgtggaattcgatagctaatggtagttctgacgcttccttgactgctgagttaccagttacccatggcttgtatgccaagaagtacaaaggtaagtatgttcaattgcgcaaaaatttgaagggtgctcaaacagggttggcagttcccaaatatatgaagaatattaatactgttgatgatctaaaaaacaaatgatattggctgtaaaatttctggcattggaccacaccaatgccagtttttttgttatttgtcatgtgaagttgatggaatccttatgaagtatctggagcttaattggtctaggtacttttttataccgtcacagtttgacgtgctgggtgaagccattggcgttgaatcttaatacggttgacaaagttctcccaattacggaagccaaaagcagtgtttttaatcttcttaattcggccgatgttgccctctaaataaccgtttgaatatggtgattcaacggcgttcagggcctgtttccggtacttcttaaagcttttgatggttgtgcccatttgtttaattagttgatgatattggcataggaactaatgaaataggtttgtattatgaatgcgcaaagactttatgatgtcttgataaatctcataagttgttttgaagtcttgccccaaatttgagacattcggtgacttcctcggtaataattttgcgtgtcaaaatcaaaagaaaagacgaccacaaaggacctatacttacttaccgcagatgaacgtatcaagatttagctcttttggaaggccaagataaaggggttcctatgatgtaatgacggacaaattgttcggtacattacaccaccgtaggagtcatgcttaaaaatgatcgaaagtcagttataaccacgttataataaaaacagcaaaaggaagtaccatcgaaaacagggcttcccgcgcaagccgcttcaaaggcggtggccttagctaaagaacgatatcaaggcgccccataaccgttcaaagttatgtagggaggcttttttattggtagtgcttgttgatatagttgagtagcacgattaaaaatgtgccaaacagcaatatcagcgagactgtctggaagacgctcattgactgtgaaaccttcttgaagattattccatgtcaactcgcaagggaaaagacagtcactgcccttaaaattgcttagtcaagcatacaaagaaatgatggattgaccaagccacaataaacattaaggtatcaagcttcctagaagcccaatttgattgcattaagtatcagcaaaacatcttttgtagatatccttttttgagttcctggagtttttcaagtttacgctgataaagagcgatagtcttgtcgagttgtttgaaaaaaatgccaattttcttttgttcttgtaaacttttaggtagtgttactttgaactgtgataaagatctttgactaacacctttcgcagtaccgccgcttgataaggatgataattcattaaatgatttcggcgaacgtaacaagacagccaagaaatcatttgtgattttatctgaagcaacatcaaaagcgattgttcgttgactgagaatatatttgttgttgtccggtatttgtgccacatttcccattggtgcctctgtggtaaataatacttggcccttataaagttcttttccagtcatccacttatcatatagtttttgatttccataatgtgcatcagcagatggatcaatataaccattttttacattaagagctgaaagggcaagatatccagactcgctccaatccatatccagttttttgggagtacgtccacgaaaatctactgtacgtctaatgttgtcgaagaacttacgctgttcccaagcgtcagcaaaccctaaaaatcttaattctgggaacttgctcccatttttggggaacaatttctgcaaatagccctgtttaagtgccttaagcttagctaacttacgctggttgactgcgatgagggtgtcgaggtgtggtagattgcaaatttaatccgaatttttggacaaatttgtcagcataacctgatacggtgtttgccagtcgagtattttaagcggtcgctggttaatttggagtaacgtcgtcgttaaatcttgagcactaatgtgctcaaaacgagtccctttaggataaaaataggtagattgtaaaattaatccgaacgctgttcggattaattttacaatctaccatatatctaagcttttttaatggtgagaaactttgccacttgcaatgctcgattaattacttaggtatacaaaatgattattgtcacgagactaaaataatcttaatgtttaaattttcttcatttcaataaaagaccggtctgccaaaacccaaagattttaacagactgatctttatttacattagtacatcttgacttatcttgaaaaaactttaatttatcctagcaagttgttgtgacaaagtttccacttgtttagtcaacttctccagatcgtgactctggttgaaagcttttaagttcgcttgcacttgccgaacaccttcctggaccctttcttggccattaacagtcaaagatagccaaacaattcgtcgatcatttggattcacttgtgattgaattaaattatcttgaatcaatcgccaagtattcctggaaattagtgtgcgcgtgaccgtgaatgcatcagctaattcactagcagtagcttgcccatgttgttcaagatagactaatattccccactcacgcattgaaaattcagttttggccagtccttgcactaacatctggtatgcctgattctgaatagcttgcagggttgttaagctctcaaactggttcttaatttgctgctgatttagcatataatatcatcctattctttgtactgccgctgagtcattccgaagagttataacaaactactcatggctaatagtaataagcccctcagtgtcatatgtcgttggtcagtttcatcagttcgaggcaaccattgatctacaaaattagtagcctctgtttgaccagcctgaaccggtttagcagcatcgttgattggctcgggttaatagaaactctaaaatctgtcgataaactatttataattcttattataataaattgattcaaactcattatgaacgttagaaatattattaatatgcattgaaggttaattttacaatctacctaaaactaaatataagttaaaagcactaattttttatcatgattaattattcaagcaacattagtaccaacaattttcattaatctaactgaactactttaaatatgccaatattgaatattcttttgccagcgttgtcgcttaactcgtcctaattggcgtcgaatccgccaattggtaattttccgccaaaggggactgtgataagccgtttgctgataaaattgacgttgccaataggtaatgtctttgctaatttgttgttgactccaccaaacataattatgagtcaaatatccggcaacttggacataaggacgttcggtccagtaggctgctcccatcaattgacctcgtgtaattggcaggcctctggttttaaaccaagccattttataaatcttctgaatcttgccaactcccatgggtggttgttgctgatcagtgtaaggagccaaaggaacgacaatcaatgcttgtaaaatttgctgggggtgcgccgtttggtttaaggccaattgtaaatcattagaaaagcgataggtacgctgtttagttgtcaattggatcttggcacaccagagcttagtcatgttaaaccaccttcatttaatttcagagtatgccacatgatgggcaaaattggcaacttttgtcttatctggatctttacgagcttctttatcaattagctactttaatttggtcttccgctcgatacttttcgatccgatagagggtaactggggcaatccccaacatccgcgcgatctgacgtttggttaattcttctccctgttcccggcgcgttagcaaacgacaggcttctttataaatataacgtttctgtcgattcggtgaatgtggtccatattcacggaccttaccatgatattttccttgccgtttagcaatttcaatcccttgtcgctgtcttactttgattgtctcacgttcttcttgggccatatacttataaagctcaataatgatattggtaatcaagttacgtaagttaggatcttcaatactattaaagctcggtaaatttaaaatgtttaaggtggcccccttatggcgaatggcttccataatttctgttaaatcggctgaatttctacctaaccgatctaaacttagcacaattacctcatcatcgtcacgaagataatccagcatggcttgaagttgtgggcgggcagcattttttccagaaagtttctcttggaaaagttttgtcactcccgctgcttgtagttgttcaatttgccgggctagattttgctcacgagtactaacacgtgcgtaaccaatttttgtcattttcagaacgcctccggatcacctatatgtaactaataataatccaactttcgaccgaatacaatagggtagaccctatcgattctatatcaaacaacactattatgtatacgaacatctgaagtatactggtacacgtttcattataagaatttgatgaatagtttacggaattggtgttgacacttaattaggaaagataggttaaataattgaggatcatgaaaagatacagaataagctttatgattgatttttcgaaagtaatgatattaacttagttgaaaacaattgaatttgttaaattcttgaagaagacgattaccaagacatagtctaggaagtgaactatttgacagcattaaaaataaaaaagagaatttcattaattggttttggaatctcagttgttattttgtatatgcttttgtattatttgtataacgtctatttaaatataatttattttgctttggcttttgccttagtacagtttacaaaagttaaccaccccttaaataatcgaatttatcgatttatcaaagaacataaaaagtaacaaaaatataatggcttattgtaaatagcttcattacccttttagtagctgagtagatgttaaaaggactgttagattatttggcgaaaattcggaataaaatcacaatccaacaataaccttttttaaatcggtaatggaaactattttttgacaggaagtgtgttactgtctatgggaaggcggatatttcggtatgcaaatgttaaagtatagtaaggaaagaatatgaattagttatgttaaaaagatatagctacataatggctttattggtaggacttacttttatagtttggttactatttattggcaacaccgtgtttactttactggagccgttcaaacgtacatggttgcccaaaagattccaacaaatagcattaaaaatcagaaaatagtttttaattgggtcaatatgggacaatgggaggaagatgtttcaattcgccaccaacatcatacctatcaatatatttataatatgtcttggcaagataaaaaagtttctttaagtatttatgatcatcgacaaggaattaaagatactctagctccttatccacctttagagtatgaccgttaacttttgcagatcttaatatactataaaatcaattaatttataaggaggtaaatgaatattgacattaactgactggagtggctttgcactgctcagctcattagtctactggtggtttttaatgtggaattcatttaacctcactagaaaaacgttagtattattaaatacggttgggacgttattaatgacagttttgacgtggtcaatcacttatggcatgttattgattccaattctaattgtgtatgcaatttcaatcgttattctgttcaaactaccattgccagcaaaaaagaatcgcggtggtctttgataaattaatagatgccaagtatcgagaaccttttgaattggtatcatgttaattcaaagggttccccaagtttttaatcttagcaaagcaagttaggtgttttagcagcgatcttttgaatcaacatgagttggatatagaaacggggcttatatgatgaaagaattcgataatttcaattattacgaggttaacaatgtttacgaagcctcattctttcagtttccaaaagtattgatgtacggcgaacaatatcgatatttaagtagtggagccaaattggcctatatggtactgaaagaccgattagagtatgccttacgcaatcactgggttgatgaggaagggcacgtctactttattttttcgaatcaggaattaggaaatttacttaattgcaagaatcagaaagtcgtcaaaataaaaagagaactcgcagctgctcatttgctgatacaaaaacaaccagtttttaatccccgaactaaaaaagatgaacccaaccgtttatatctatctacgcttgatgtgaaagcaactgacgtttatttacggggaaaatatgggcaaaaaacgtcgcaacccctaggtacaagcagaaatgtgaaaatcacacataatctagatagagaacctaaataaaaatagatatcgtttgttatgggaggcagtttctgatgagtaaaagagccttgatctatattttacggtatttactagcgattgggttatttgctgtttattatgcagtttttgaaaatcaaagccatgatttaattcagaccgtttttgctgttgcaatcggcgttggaattgccactttgcccgttaaatctaaagatcaaaataaaaagtaattcctcaattgtcaaatcaagtgccacactaataggatatctaaaacaaattgttgccaggtaatattgctgggataattagtcatcataatttccttttttgtcaaaatatagtaaagttcaagtcagatctcaaacagtttcttagctctttagttattacatttaagtgttaaagtagatacatcttgaatgaatgtaacttttttgtgaatgagggaacttgtatgtataaaaagatgatcataatgcttgttactgttgttacttttattgttagctttaatattaatgctttaacggcctctgctgtacctcttgatcactaccatattgtcattacttatactaagccttataaaaaatatattggacataagtatagtaattggaatactatttattctgcaaaaaagaaaacaaaatcgactttttctaaatcggtaacgtgggctaactctttaacagggaatgtttcactgtctaaggggaagttgactgctttgttagggtttaatgtaacttggtcagataccgttacaataaatgttccgttttcttttaatggaaaatatcgacaaaaagttcagtatcgtaagaggtatcgaaaatataagattacgcgaatagaatacctaaaaatagtcggatcatcaacacaaaagaaacatcttaaggcttttgcgtataagtacgatggtgttgtgagtcgtgttgttagggataagtaggtgataaaattggatttttttaaactatctagtttgtttggtagctttgccctattaacaatatttttactacaaattatgaatgttttttctgagatgctatcaacatcggatgttttgcaagatggaactaaaataactaatcaagttaattactttatgaccccattagttacaattccagttatttttttaatattgttttttattttttttatacttggtatctgtaaaattaagaagtaataaactagtgattgattggatttaaaattatgtaatctttttttgggggggagattgatgaatatcagaaaaattatcttgatcaaaaatgtaagctataataccgattgcgcctacgtcaagttttggtactaaatttcagtataggggcagatagagttaattatcatagatcggcatctttgactttgaggactttgtatatcatgtagacaatcaaaataatataaattcctattaggtataggtagaacggtaggccacataaaaatcaacaatattagaatgaaattgatactatcttgccaatcagagtttggttcatgcttgttcataaaaaatcatcagttcatcggttgaatctgtccgtaaacagaaaataaacttgctttaatgttagctgtttgatgaagcgatataaagatgttttgacattgatggagttggaaatagaagaatgccaagttggctttaaaattaaggagatgggagattcatgagtacgatcaattcagagcttcagaacaagttaaaaaaggctgcggcggttaaagctgcagattatgttaaagacggtatgattgttgggcttggaagtggttcaacggttacaatgctggtcgatgagttgggacgacgggttcaggaagacggcctgaactttacgggcgtttccacgtcaatttcaacagcgaagcaggctgaatcattgggaataaaaatttctgatttggattcgattgacacaattgatttaaccattgacggtgccgaccaggttgacagtgactttaatggtattaaaggtggtggtggaaacctgttttgggaaaagattgtggctgccaattctaaaaagcttatttggatcgtagaccaatccaaaattgttgaccggatcggtgcctttccactggctgttgatgtagaaccttttggcagtcatcatgttttgaaaaaattttccgatgccggatttaatccggttgttaggactgataagaacggcaagatctttaaaacggactcaaataacatcattttggatcttcatttgcataaaattaacgacccagataaactgtctaacgccttaattaacacagttggtgtggttgaacatggcttgtttttaaatgcagttaatgaggttgttgtgggcaaagagggggcacctcaaattatgattaattctaaagcccatccatcttatcaataaaatgtcacgtcttgattactcatattaaattagtcggttagaggagcaatataactgtggttcttgaccgttcaatcataaaatcctattaaactaatctttaagactggtttaataggatttttgggtgcaatacaaagtgcataacgagatgtgttataagatacaatatttgagttgagtcatatttttcgatgactgctctttgatgattatccggtcaacatcgatcgctatgataaaagtcgaaataattaaaaatgagattgccgacaactccgcaaatgagcagagtgaatccataaatcagtgattccattagttttttatgactcaaattcgcttttttacatagaagtgtgctctattaagggagatcttagtcgttttcaagattactaatggcattactattgttaagcaaagcttgctttactttttcacttatagtgtttttttgtttatcttgtttttcagattccacgtaaatcaactcccgtattgttacataataagcctaatttaacacaaaaacattgcgcctcgttatcaatttagttgttattacattaaaaagccaatggataatgatcatctcatttagacaattctattgaacatttttaaacagcattagttcatacaaataggcaaggtcacaagagcataccctattggcctttttttatttctgtgcttgactttttgcaattttgcagaaatatagaatcaaacttattcaggagaattggtacttatattgtctacgaatgggtttagtgaatctttaggcacgagctctaaaaatgatttgaacaagtttgtaaaatctaaaatagctttatctgtatctgctttattatttagaccattttttagtactggactaaatggagaaatagctataggaagagctgaatttattaatgggctccacaatttagctccttcttcaattgatttcatatgcatgaagtggataaattgtttatttgaaaccttacttgtaacaatgtccggtaatattgctgctattgcagaaatcataagccaaactgagccgcgtacacgtaaaaagtctagtatttgagcatctgtatcagaaaatcctatattactatcttcaatgttgtcctcatttttttttgagatcaattcttgctttttgttttgaagcgaaacatacatagtatatgcaaagagaatattttctttacttgtcgattcattaaaaatcagactatagctattattgttttcccatagttttttagtcgattgatatgcatttataggataacccatgaatgaggttagcacttgagctattgtattattattaagcaattttgaattgcgtttcatagcatcaccgtttccacctctgcgtcccccagaataatccgcaatatcagttttatcaaattcccttctaagacgtttttgagtttgatcattactcctgaaatctgccggattcattgcgttttgtttgttattatactcaataacgttatccaaaacattgtgatcatctatttgaacgactctagtgaaaacgttccccatggaaggagcttgccccattgaccctattgctccagttgtctgagcaccatttataacggaaattccatctaacgttaattcttttttagaattgttatatgaatatctatttgttaaaaatgtaatcccgttattgtaaatcaaaaaatctgccggacttttctctacagaatctttaattcctgtattaatattactggatagccttcgactgccaagatattcacgtacattggctgaaaataaggaatcgtgatattctgtgtatatttcatataaaaattttaacggaatactagtcataaaagttttccagttggaattatttcccttagattcaaaaccaccagtaacctttattttaaaggattttgttactgctattttgctatgaatactttgataccatgttgataaaacattacggccaacctcaatagtgttaactgctacattatttaagttatcagcgtaatcactttttaaaattgaatgagttgtgttggcaactgactttaactctgagttaacttcgtcggattcaggaagattatgaacataccaaatttccagtttttctattttattttctttaatcccagctcttaactgatgcgcagcagcttgtaaatcttttggcaaatctgattcactagagtttaataaccagctcataccggagtttaaatcagcggccttgttggactttgcgcctttttttgtagtatccttagataaatacgattgtgcaactattgctaactggtcatctgtattgatataaacaagatcaattttcttgtcattagacccatcggttaaatactctgctgcagattccatgtctaatccttcaaatcgaagtgttaatgcatatagtaatagtgcattatcaccatactttttaaaaaaatcattttcggttaaccagcttaatatagtatctactctattatttgtcatgttgtaaaaacccctcctaaaacaaaaaatctcacatcaatcgtacgttaaaaatgatcttaaataaagtgaacctgatcaattaattgcgacaaaagtctttttgattattgttggctacgttgtaatcatacatttgatcagtgataatcaaaatatagaccgttctaagcagttttaagggcggtggctgtcttttcccttgtgaggtgaggcccatgggaacatggaataatcttcaggaaggtttcacagtcaatgagcgtcttccagacactctcgttgatgttgctgtttgcaatgtttattttggcgttgctaacgtacatcgacaaaaggaacaaataaaaaagccgccctgcgtaactttggccagttacagggtagcttaatgctgtcttattaacttcgccaccgcctttgaagcggcttgcatgggaagtcctgttctagcggggcttccctttttctgtctacattatagcatgactataatggactttcgactatttttaatcagctttctaacagttcgggggcacacacgttcgatttttatgctacaatacaggtaaaagctagcggaagtgatcaaaatgttttttgacgatgaactgcatggcgtgttcttcttaatcgataacaagtccttttatgctagttgcgaagccgttgccgggggcttaaccccttaaaagtccgttagttgtccttaagcataccaatggtgggctaatcttagccacgtcacccgaagctaagcacttatttcatattaaagccaatgtctcacgcaaacgtgacttacccaatgatccccggctgtgggtcgtgccaccacgcatgaacctttatattcaacgcaatttactgattaatcagatctttcatcaatttaccaactattgaaaatatgggcagaaaatttcttctcattttgcttacggctcaagaaactctgaatgccttcagtcgaagataccgtaatgtcaattggtgcattggccggcaaatatcgctgggcggcattttgaatgtattgggtaaaactgatgatctcagtctgactataaaattgagtcgtgatgctgatattcatcccactgagtgaaccatcggtgtattgtgcttgagcagtcaccccactcaaattcgggaagaagccttgaatttctgatttgaagttatcaaacgaatcagcatcattttggctgggacccttcttgtcagattgtaatgggaagacgtagttcttttgattgattttgtcccacttggcaactttggtttcaccatcgtcattcatggaatatgcaaagaagttcccgccgaccaggctatcatccgaagcttgcttgtataaagcaatgatgattggaatgttcttcagcgatcgccgttgtcgcagccgcttaatcacttggttggcgatagctttaccctgctttttaacttgggcatcagaaatgtcggtttcataagttggcccataggccgtcttcttataataatcaaccgagttaatccccagtccgatggtcatccctgacaagcgaagcgatttgccgctttgagtcataaaatcctgctcatcaatttgggaaagataaattggatttctagtgttagggttggtcgatttggacttaaccggatttaagccggttgggtttgatttggattgacggcccaaccaattttcaaccgtgctggtagaaagatattgaccttcttggaagatgtattttttagttgaaaattcttttttggaaatatccaacaggccgttttcaaaccctttaatattgaactgattcgattcttgagaaacactcacaccacgagatttactggtctgataacggccattcttaatcacaccttgataatagtcggtgttcgtttggccggttaactgcgtcttggcttttgagccactggaattgctggtatccttcgacagattatcaacgcttccacacgctgccaacataaatcccgacagaatgattgaaatccccaggataatttttttcacgattcgttcctccattgtcacttttcatcggccatttcttggtggaaacgggcttcgtcccatgtctgaatgccgaggcttttcgccttatcatacttgctgccggggtcttcacccacaacaacgatgtctgtatttttggaaactgaactgctgactttggcaccatggtcctcaagccattgagttgcatccggccgggtgatattttgtaatttccctgtcaaaacaaacttcttgccggtgaagaatgaatcactttcagcaagttgttcatcagtcacacccagataatccatgttaacgcccacttgtttgagttggtcgatcaactgcttggattcaggcattgagaagtaagtaaccacgctgtcagcaatgatcattcccattgtagcaatttcggcgatatcttgcgcgcttgcctgcataaccttatcaatatttttaaaacgttgggcaattaatcgagctgccttgatcccaacatggcggattcccaaaccataaagcagtcgttcacaagaattcgatcggctgttatcaatggcagccagcagcttagtggctgatttttcaccaaatttgtccaaagttaatagttggtcaaaggacaaatcataaagtccggcaacatcggagaccatgtgtttttcaaacaactgggcgatgatttttggccccaaaccgtcgatattcatggcatccctggaagcaaagtgggttaagccttctttgagttgcgccggacactgaggattaatgcagcgaagcgccacctcttggtccaagtgaaccagcgtggaaccgcatgatggacactgggttgggatttcataggcctgactgttggcaggccgtttatctggtaagtactgcgagatttcagggatgatgtcgccagctttatgcagcttaacggtatcgccgacccggatatctttttctgccaaataatccggattatgaagtgatgcccggctgacagtactgccggctaatgtcaccggatccataaccgcagtgggtgtcaccaccccggtccgtccaacggtccattcaatgtccctaacaatcgtttgaacctcttctggcggaaacttgtatgcaatcgcccagcggggaactttaacggttgccccgagtgagcgctgcagcggtagtgaattgaccttaatcacaatgccgtcaatcccatagggcaaaccatcccgtaaatctttgtatttatcaacgtaattgtcaatatcagccatattgtgggcaactttgaaatctggattgatcgtaaagcccaattctttgagttcggcaagcatcccgctttgagtgtcagattgcagatcatcgatatcggcaacgttatacataaaagtacttaatttgcgactgcgggtcacacgtggatccagctgacgcaaacttccggccgcagcattccttggattggcgaatggttcttcaccatccaactggcgctgttcattcaatttggcaaacgattctttgggcatgtaacattcgccacgaacctcaatattgatcggtcgagtcaacttttgcggaattgacttaatcgtctttaagttacgggtaatatcttcaccaatttgaccgtttccgcgagtggatccttgaacaaagaccccgttctcatatcgaaggttgattgccaaaccatcgatttttaattcgcaattataatcaaatgcgactgaatcattttcacttagacggtcgacgaattccgccaactcttccttagagaaaacatctcccagtgaaagcatcggaatttcatggttaaccttggtaaagccggggagcgtgtggtcgccgactttttgagtaggtgaatcaggagtcacaatctgtggaaattggttttccaatgcgaccagctgctgataagtttggtcatacacggcatcttcgacacttggtgcgtcataggtgtaatactcgtcagcccactggttcaattgtttcctcagatcgccagccttagcagcggcctgttgctcggacatattttcaaatgccacaataacaccttctgttgattaattttcctgcttcttaattggggcaaatgcagccaacagccgcttgatgccctcttgcttgaatgcaatatcgagctccatatcctcgccggttccggtaaccttgacaaccgtgccggttccccaagccttgtgtgatactttatcaccaacggcccaagcgagtttgtctgcaccggatcctttagggctttcgacgacttttccaggtcgccgataagtagttgccgttgcccgcctggttcggcgatcaaacggcgtgcttaggggggactcagtttgctgttgattatccgaatggataagctctgggctaatttcgttgacgaagcgcgactctggattgttttggcgacggccatacaacattcgcgagtaggcattggtaatatagagtttttctttggcacgcgtaatgccaacgtacgctaatcggcgctcttcttgaagttctgattcgtctgctgcggctcgtgaaagcgggaataatccttcttccattcccatcaaaaagaccactggaaattccagtcccttggctgcatgcaaagtcatcaaagtcacttgggaattgtcttcttcgagactatcctgatcagaaaccaaggccaaatcacttaagaaattcactaagttctgttgaccggtttcgccctcgttttcttcatcatacttttgagtcacagaaataaattcttccaagttttcaagcctggtttgagcttccaaagacttcgaagctttcaaggtacttagatagccactcttatcgagaatttcttcagtaatttcagtgattgataattgtgccatcttctctgaaatcgttcgcatcgtctgttcaaattcagcgatcgaattttttgcacgggtagaaatctcattggctaaatcaacgtttttagcagcctcaaggagactccactgatgatcgttggcgaatagtcgtaatcgttcaatactggcttggccgatcccccgtttaggttcgttgatgacccgttcaaagctcatggagtcgtttggattagctaacagagtcaggtaagacaaggcgtctcgaatttcttttcgatcatagaacttgtgtccgccaaccatggtgtagggaatatttgatttgagcaaggtttcttcaattacccgtgactgcgcattggttcggtaaaggattgcaaaactgccgtaattgcgttttggcttggccatttcttcttgaattttggcaacaacgtatcttgcctcgtcgttttcggtctgaccacgataatatgaaatctgatcgcccttgggattttcagtccacaaatttttgtcggcacgattgtcattatgggcaatcaccgaattagcggcatcaagtaccgttttagttgaacgatagttttgttccaataaggtcacatgggcatccggatagtcttttttgaaatcaaggatgttctgcatgttggcaccacgccagccgtagatactttggtcggcatccccgacgacacagatgttacgatttttcttggcaagggtattcaccagtcggtattgagcctcattggtatcctgatactcatcaacatggatgtattgaaatttgtcctgataggattccaaaacatccggatgttcatcaaataattggatggtgatcataatcaaatcatcaaagtccaatgattgattctgcttcagctctgcttggtagcgatcatagacgtcagccacgatttgatcgaaagcactattggcctgagctttgaatgctttgggtgtgagcagatcatttttggcgttggagatagccgataaaacggctctgggatcgaactttttgggatcaatattcaaatctcgcagtactcgtttgacaagcgtccgctgctcactggtatcggcaatcgtaaaagccttattgtagcccagcaaatcaatatggcggcgtaaaatccgcacacatagtgcatggaatgttgaaacccaaacatcgttaccaccttcacccaacaattttgaaacccgttcacgcatttcccgggcagccttattggtaaaagtgatcgctaaaatccgccacggcataatatggttatgttcaattatgtaggcaattcggtgggttaatacccgggtcttgccactgccggcaccggccataatgaggacgggtccttcagtatggataacggcgtctttttgatctttatttaatcctgctaataaactttcttctgccactaaatattccatcctctcgcatttatcttttcaattataacaaaaaagtcggcttcccgactctctacatgttgctatattttgttttgtaatctatgtcatgccaaatcccagtggcctccagtttaaccagggtgtctgaaatagatttggtcggaatcaggacatgcccaaccagctgatggtcgtcagttggctcgttgccataaaacgtgaagtgccaattatctttgatgacccattgggtttggacacgttgatattcctgttgtcgaatggcctgataaaccgttgcaattccgggaataatttgtgtcaaaggcaaaccggcaattgcccgcaaatgttgttcaaattcatcggcattagcagcgtaatcaaatacaaacccagccgcactcaatttgggagcaactctgctgacataaatcgaaccgctcttggccaagaagagtgtgacttcgaaagtaccgacatagtcaaggttgttggcaatttcattggtaattcgggtcatttccttcttcacactgggatcgagttttgccggcgtataggcggtcattaactgatcgccttcatacatcacttcgactggtggaaacatcacaattgaccctgactcggtccgggtaacgaccacggagtagtcagtatcatgttccacataggattccaaaatgtaagttccggaatctaaaaaaccggatgccaggacaatatcagcctggttcttaatcagcaattctttgccgccatttagtccccgctgaatgggctttaaaatagccgggtacccaatggaattaatggcttggtaaatgtcttccaacgtgacaatcgtcgagtaaggaaccatgttaatattcagggtttcaaaaaacgttcgttcaatcagtcgatcttggacaatatccaataatccgtcccgttgcggcacagccgtgtattgggaaatgtatcgaatgacatctgaatcgataaattgattgtcatagatcaccgcttcacagcgttcggcaaacattttcaaggtttccttgtcagtgtaggggccaatgtatttatagtctgccagttccatcgccttactgttttcgttggaactgtacatgccaacattaaagcccatttgttttgcgcgagccaataacgttggggtgctgatactatctccaagaatcccaattgtttgaccgggatagataacatttgcgtttgccaattaattcactactttcatatcgtcattttattaattgtaagtcatcattaaacttatcgtaccattattttcacagctctaatcaacaaatgtgactttttggttatccagagaggcaactcgagccaaagactccaaacggacacctgatttttcaatcatggtgtgccctttttggaagctcttttcgatcacaatcccaacaccttcaactttaacatttgccaactcggcaatttccaacagtccttgaacggcttgaccatttgccaaaaaatcatcaataatcaaaattcgatcatttggcttcaaaaatcgtttatcaatactgatatcgttgctaacttgcttggtataagaataaacgctggcggtgtacaggttatcggttaaagttaaactcttatgctttctggcaaagatcaacggaacccccatatggatcgccgttgtcaatgccggggcgattccggaagattcaacggtcacaaccttggttaccccttcatctttaaataagcgggcaaattcggcaccaatttggtccatcaattttgcatcaacctggtgatttaaaaagttgtcgacctttaatacgtttcctggtaatacagtaccatcctccaaaatgcgtttcttaagtaagtccatctcaaaattcctttctagtcatcgtattgataaagtttgtattgtctgatgatggcgatcaatttcttggtataagcagggtcggtcgcatagccatcctgctgaagaccatcagcggcctgcaggtagttgtttgcggccaccacgtccttgtactgctgtgggttccatttcgtgccataggcaagcaatttggcgtgatcagccaaggattcattccagtcctgatatacttggaaccgagctttgatcgtcacataacggccattcacgaattcctgcgtattcaggtagaccgagttggtggtattatcctgagctttgacgccaaacagattataatacttgctcgcaagcttgctggtgccccagttggactccaaaatggcctgagctaaagtaatactcggtaagatattatattgcccctgcagccgctgggcttgtggcgctaatttgttgataaatttacggtgctcaatggccacttcgtcgttcgagctttgaatattgctcgaatgataaccgttttcgtataaagcgtggaaaccaaaaatgatcaccaacccacagatcaccagaatcaacatcaaaacggcatttgctttttttgcgcggcgtttccgccccttcttatattttgccaatccaacctcaaactttctaactttaaaattaattctaacgataaatccgaataaagacaaacgaaatttgtgctttgttcaatttttataaatgcgtaaaaattgacaaatctgttaatttcggttatgttatcctctgacacttaaatctggagatgaaaaccaatggctaaaaacaccgaagtatcagaagctcaatcaaaatttcatgttggtgatgaggtttcattcaagatcgaaaaacagacgtttaccggtttcgttgataagagttacaccaactcatttttaatcacttttgaatcggatgatcctgagattatcgacaagtaccacaaaaaggttgtcatcaataatcgacatctcaaaatgatcaaggcagctccccaacctgaagttgaggatgaggacgaggacgataatgaaactaaatcccccaaagccaaaaaatcgagcaagaaataatgattaaaagtagaccctgcatatatttgtgcaaggtctattttttatctgctggtccggtcaaaaatctttttaaccggcaccgcaatcaacggtgtgacaattccgctaaagattgcttccggaacaccattcgtaccaaccacccctagtaaatatgggaggagttctttgatattaatctgatacagttgaggggctttcgccttataaaacagataaatgagtcccagcaccaggaccgtgttggttaatgaacccaagacagccgatacagaaatactggctgcctggcttttcaagtgtttcttgagatacgtgtacgtcataccagcaactacgccaatcataatccgggggatgaccgaaataatcgggttaacaaagacgattgccgctaaagggctggtcggccatacaaaagctcggacaaaagtcgtcagcccccaaacaccaccaatgatcgctccgtcaacagttccaagcaaaaccgttgcaacgacgacagtcatcgggataatcgtaatttcaagtggaccaattgggatgtacccgatcaaaggaatcgaagtttgcaacagaatgatcgcaataaacattgccagcatgttcagtcgtaaagtatttttcttaacaggcatgtgttcttacccctttaaagttgttggaaccattatacaataacggattgtattctaatacaattttgctggtgaatgtcagtttaccaacaagcttaaaatattctcaacaaaaaaacattggtttctcagtttaatgtttataacgagaagtctctgaagcggatccagcgagggttcaaaggactccaggacaccttggaagcatcatttatttaagttagatacatattatatgtacgaaggcatttcatttatacgtattaaaatagaattgttttttgggggttaagtgatatacaattaaagcgttttaacaaaataaaatatggggggattttttatgagaaagctagtaattaaaattattgtagcttcaattttgttgtcgtttggaggatcagtagtactatattttcagcatgtagcccggcgactgaatgcttataataattcacaccgcaagaaacatatttacatggatatgaattatcacggtggcgtatcttttcacaccatctaaggaggtaaataagatatgaatattaaaacaatcgtaagtattgggttacccgtacttttgattatcagtagttttattcctggaaaatataaaaaatgggtttttcttaaatttggcatgtatagatatattatcatcgttcccgtgtttggcatcgttttggcaatgttctggatggatttacgtgcgctatttcctatggtgatgattttttcgctgcttgcacttttttgggattggcgtacgttgaaaagaatgaaaggctaattaataaggtctaaaatagtggttatcaataaaataataatgaatctatactatcacattcgaagtaaagaccttttttaacggttatattgatcaaaatgtcacgtatgcaagattttaagaatgaattatatttaaaaattattagactataaaactcagtaaatctattgtgaacttaggtttactgagttttttgtttttctaacttaattttacaaacggcgaaaaaaacaagcctgaaaaataaactttttcaggcttgttatttattatggttgtgattgtttgtgtgtaggtaaatctaattgttgtgcttgatcggcaatcctattagtcgttgcaatctgttcgtccttaacctctaactgctgtttaagtagctcaataaaagctgattgttctttggtttgagcctgtaaaaaattattaaccgtcaaaccgtaccaagaaattttcgtgatcgatattagtaaccaagcccatatttcccggcggactttttaccggaatttcaaaagcaaagacgatgtgattaatcagtatgttatttccttactaaagaaatacactgattggatcttgcaagttaacccccaaacctataaagaagtcatcgatgacttctttacttactggccagctcactcagctaaattggctttgttagttaaagctggtttaagctataagatcttggataatgctaaccaaacgatgccggttttctttcggcgtttccatctccgccaccccagtgttgcttgacacgtcgatgtcactaacgataccaaagttgaatatatgacccgcattgccgtcggtattttctggaatactttttgcttatggttagcccagctgacgtcgatcaccattcaaaatttagcaatcctcgtcaaacatgatttaaagcaactgggcaattactagtggccgagaaatgctaaaatagagttgagttaacaattatgaagggaggagcgtcaattggatagtgaaattattgcccggccattggtgaccatcaccaacgtcatttggagttttaatactgaattacaccgaccacaattactattgattaagcgggcagatgaacctctaaagggacattgggccctccccgaaaccctcttgcggagtaaagagagtgccgacgcggcctgcattcgtctaattgacgataaaattggcctgcaagttccgatgaattcaaccgaacaactggccacctttacagatcccaagcgggttacgggaactcgggcactggcactcgcctatatgacctatttaccatcaaccccaaaattgcatccagggtatggggccacagatgcccaatggttcgtgcttgataaagatcagggaaactatgtgatcacccatgaccaacaggagattatcctaagtcccgccggtcacctggtctttgatcatattcaaatcattaccaccgccattaatcggattaaaaacaagctggactatcaaccccaaatgcttcggatcttaggtaatacctttaccctgcgccaagcgcgcgaagtctttgcggctttcttaggtacgacaattgacaagattgataattccaactttaagaaaactcacaaccacctcttcaaagaagtcggggccgccactttgaaccattctgggcggccaccaaagctctaccaacttaactaaagggcatcatttgcattttgctgcaaagtatttatactagacgtaaataaaagttaaccatacttttatttttagtcaaattaaagtaatttttacttaaaaggaggtatttaagatgaatctacaactattaaccgacttatatgaattttccatggccaatgggtactacgctaccctaccccatgatcgacaagctcgcttcgacgtcttttaccgccgggttcccgacaacggtagttttgtcattgtcgctggtctccagcaagtggtagaacaagttcaaaattggcatttcactaaggagaatattgaatacctgacctccctgaatgaatttactcccgagtttttggattacctgagcaagattaaaaatcactgctcgattaaggctttaccagaaggaacccctgttttcccacgggaaccaattatttcaattagtggaccgttgattgaagcccagctgttagaaacctttattctaaacatcattaaccatcaatcattaattgcgacgaagtcttggcaaatcaaccatgccgctcaaggccgaccaattatggaatttggcgcgcggcgggcgcaaggccctgatgccgccacgtatggggcgcgagccgcggtgatcggcggttgtaccagcacgtcgaacttacaagcagccagtaaatttaatattcccgcggccggcacaatggcacatgcctgggtcgaaagcttctctgatgaattaagtgcctttcaagcttgggccaaggtttatcctgacaaagtttccttgctcgttgatacttatgatgtcttgaagtcaggagtgccgaacgcgattcgggtcttcaagcaagttagcgctcaagggcaccaaccagtcgggatccggatagattccggtgacatttcgcaattagccatcaaagcccggaagatgctcgatgatgctggcttccccaaggcaaagattacagcttcaaatgcccttgatgcgcatgtagttaagtcgttgttggatgaaggagctccaattgataactttgggattggggaacgtttaattaccagttcctccagtccggtattaagtggcgtttataagctcgccgaagaaaagattaatgatcaatggatcccaaaaattaaggttagtgatagcagagaaaagatcaccctgcctggtaataagcaagtttaccggatttaccggcaagataaccttcatcaagcgatcgccgatgtgattgccctggctgatgagcacatcacggctccattgaaagtggttaatgctacttcggcagccacgcacgccagccaagttctgactaactttaatgctaagccattgatgcaagaatatctgggttccaatgcttccccaatcgaaaatgatctctttaagattcagcaattctcaatggatcaagtagcagaattaccagaagccacaaaacggttagttaaccccgatcggtacccagtttacttaacagctacattggctgaattgcaagaacagttaattactaaagctcaatttacggaggaacattaagatggctaaagcgctcttaattattgactatacaaacgactttgtggctgataagggatcactaacggttggcaagccagcgcagacgttggccccagaaattatgcggttagccgatcaattcttaagccagcatgattatgtgatctttcccactgatggtcaccggcttaatgacccattcaatccagaaaccaaactatatccggcccataatattattgggacgaccggtcagaaactatacggccaagtcggcagctggtttgatcgacatcatgacgattcccatgtctacaaattcaataagaaccgttactcctccttccaaaacaccaatttggataactacctgcgggaacggcggattgatgaagtctggattgctggtgtctgcactgatatttgtgtcctccacaccgcaatcagtgcctacaacctggattaccacattgtgattacacaagcagccgtggccacgttctcaccagctggtgctgaatgggcgatgaatcattttaaaaacgtattaggggccacaattcgataattcactttcaaatgattatcaaaaaaaccacgaattaattacaaaaaattccctttgctaaatgcattgggaatttttcttttggcgttacctttctagggtaaaaggtaacattttattttcaaatacaatcttgaaaataaaatttaatggttattaggaaatgtgttcctaatgccctcggcagagctccctagtcaaaatggggttactccattttgactagggagctagtaaattggatatcttatccactttactgtactgcaaacatgttataattacttgtaagataataacttacggaggcataaaagatggcaataaaatgtaccgtaacaactgacttacaagcgaaagatactaatggatattccggcattcagaagcatgttgaacatgatgaaaagattaatcacagtaatcaagatattgtgtttaatgaaacgcagttcaacgtgtacgatgaatcgaaagctactaagcatgcaatcgaagaatggaacaacaaacacttccagaactatgttgagcacagttgtttgcattccgattaataaatgataccactctaacatgattcccatcattttctcaaaatagttttgctgctcataaaaaacggtttttcatttatctaacacataaatctcatctttttatattaaactttttgcgatatctgataaaggtcgtccgtttaatcccggtatttcgagtcacatcaatgtcactcatgcctgcctggtaaagcttaaaagcatgttgcaagcggggatcgtcttgggtgtattggggtttgcgcccatgatatttaccctgctgcttagctaaggcaatcccttgctgctggcgctcaatgattcgcttacgttcactttcggcctgatacttatagagttcaataatcaagttggtcatcagttgacgtaaatttgggtcagcaatccctgtcatggacggtaaattcaacacatctagggtggcacccttattttgaatggagttcatgatcttagtcaaatcatggttgtttctgcctaagaacctgtctagtatctgctgaatctggtagaattgtggaaaaccgactgaggagtttgtcatgccagattatccaagcaatatttctcgagcgcaatttgcgttaatacaacctgatttagaaaacttccgcaagcatacaagaccgcgtcgttatgatctttatgacgtattcaatgccatcctttactcgcttactacagggtgtcaatggcgtgaattaccgcaagatttcccggaatggcacactgtctaccgctattacgatatgtggcgagataaaccagacccgacagctgattcgctattagaaaggcttttaaaaaaactgttgcttcctatcgctttgcacagggccgatcggcccgaacgtcgtttgtgattgttgatgctcaaagtgttaaaaccactgatttaacgaaaaatagtggctacgatggcggcaaaaagatttcagggattaagcgtcatatggcggttgatattaatggtttaccacaagccattctcgtgacacgagctaatgtatcagatcgttcaggtgcattggctatgtttagtttggctagccaaactttagagctcgttcagcatgtcatggttgatggtggctacactggcaatgactttgcggatcaggtgaagctcattttgaatgctaagacgacggtagctaaacgcaacgagttgcatatgttcacggtgctaccgcaacgatggatcgttgaacgttcatggagttggctagacaaatgtcggcgactttggaaaaactgtgaacgcgcccttaacagcagtcttcaaatggttgtattggccttcctgaagatagttcttaaaagatactagacaggttctcagaactgctcattgctgcacttgtctgtttcttgtcagactcaattgtgtcttggctaattgccgcttgtccgctcgcatcgttctggtgtgaggatagatcggattttggcgccgcacggtcatgttcggtgatgtttgtctcaccgttgtcggctacagggacaacggcgctgccgacctgggtcagcatcaacatcgccaacatgacgatatggatcaacttcttaggcatctgtgcgcctccttccattgtttctggcgtctctcttcttccaacaccagcttaacaagttgaccccgcgcaaaggaatgataatgttcgttatttaacaagatatttttaacagttcatacttattgacattataggtattaatctgtacatataatgtaaaaagctctatttataggtaaataaggtcttcaaacccaaaagtagccttgaaacagccggcgtattgccagtaagcttcaagactacttataggttatttattcaactaattagtttaagctttgatgattttcccaactgcaattggtaaagtaacgtgggcatcgtagttcatgacagttccttgaacagtagccggtagcttcaaggtatccggcacaccatgaatataaatgacccttttatcaagctgcaaatcgtcactgccaaaagcggctttaaacgctgtctgcaattccttcagatcaacgagtttgtcataagcatagtgaccttctgcatcagccactgggtaactgtcatttggcacatgcatcttggccggttcagcgtcaaatggcaccatcgttgtaccggaaaccggttctgtttctggcagatcaacgaaaccgtcaccattagcatcttgtgccgctgtggcgatttctgctggcttaccatccgggaatccgtggaaatgttcccaatgctgcacattagcaggtgtatcaaacatatcgatatgaatcttcatttgcgcaccatcaatcgtgaacgtcgcggcaccgtgcggcgcggtgccaatcttctcagcgttcaatggcacgatttctgctgtatacttttcagccatgcaaaccactccttttagatttagactcagtttcagtatagtgctaactggaacgaatcacaatctattgcatttcaaaagtgaggttgcaagattatttggccaattgcaataaccgttggcgcaaaaaggtaataatatcacaccgcaccggtgttagttagcaaatcaaaaactattatttagaatataattcggacttattttcttgcttctattgctcgttcaatccgcccctcatcataaagccgcaatacaaaatacatccccacataaataaccaacggaatccaaacataattcaaattaatcatggtgagagttgcggcattctggggtcgattggcaacgtaacccgaaaagtgaaacaaaccagctgtaatcaagccgccaacaccaaggccgacgttaacgccaaagtcatccgttgaagccagaattccctcggcttggatccccatgctggcaccataacggattgtgtcagcaatcatgattgagacgaggccgataatgatcccattgccaatcgagttaatcaagacaccgccaaacaagaaccacagtattttggtataaaccccaaccgcaatcacggcttgaccaaccagcgccattaaaataccgcgaagcatcgtttgcttcttactgccaacctcggtaattcgaatgatcagcaataccccgattaacgctgccagggtaaaactgttagctagtggcaccaggttttcgtttcccaccgtatatttaaaatagtaaatggttgtctgattcttaatcgccgtcaccagccagtacatgagaatcacgattgacataacgatccatggctgattatgtttcaacatttttaggacagttgttaacggttggtgggcaatttcaggattcgcgaaccgttcgcgaacatggacaaacgtgttgataatcaaaagaaatgaaatcaggctaaacacgatgattgtgcccaagaaccctttttgctgattaccgtggccgaagaacgcaaccaagggtaatgtgaataccgccaccacaatttgaaccgaactgccaaagaattgacgaatgacacccaacaacgtcaactcacgagtattctgcgacatcgttggtaagattgacgtgattggcagattaacagccgtatacagaaatccaaggcctaaatacgtcacatatgcccagattaatttaccattatacgaaaagttaggcgtcacaaaggtgagaaccgcaaaaataacgtaaggtaacgaataccagaggaagaatggtcggctcttgccaaaccgtgaatgtgtgtgatcaatcatgatcccgatgacaaaactttcaacaacgtcagctacccgcgccacgacaaataaaatggccaccgcgcttggtgtcagtccataaacatccgtgtaaaagaatagcaaataggtcgtcatcatttgaaagactaaattatcggcggcgtcacttaagccgtaactaattcgttcgggccaccgtgttacccatttcgtcgtgcttttcatcccatcatcgcctttatcgaaattgttaatcaactgtatcgtactctaaaattagttctcatgatatagattgtacacaatttggatgtaagctgattcctgagacaacttttaagtaaagaaaatagaaaccctttcagttaacatgtgctaaccaaaagtaataggtttgaaaacccatccattaccatattagcacaacggcattcaccatagtataccaaatgatcataaaaatcagaataatattaaaatgtatatattattttagtacatgaagtattgctctgagtaatgatgctaaatcgctgcagccagatttacgttataattaacccaacaacaaaaaaggacgggatcacatgaaattcatttcttggaacgtgaacgggcttcgggccgctgtgaagcatgactttgccgagacatttcagcagttggatgctgatttcttctgcattcaagaaaccaagatgcaggaagggcagttggagctggatttgcctggttaccagcaatacttcaattatgctgaacggaagggttactccggcacggccatttttaccaagcacgcaccgatgcatgtgacctatggcattaacggcgacgagttcgatcacgaagggcgggcgatcacccttgaatatcccgacttttatctggtgaccagctacgttcccaactctggggctggactgaaacgactcgattttcgtatgggctggaacaaggccttttaccaatacttaactgaattggatgccaaaaaaccggtcattctctgcggcgatctgaatgtggcccacaaagaaattgatttgaagaacccgcaatctaatcaccacaacgctggctttaccgatgaggaacgccaagatttcaccaagcttttaaaggccggcttcatggatactttcaggcatttttaccctgaccagacagacatctattcctggtggagttatcggttccattcccgcgatcggaatgccggctggcggattgactactttgtggccagcaaccggttggcggatcagattgaggactcgaagattttgacggatgtgttcggctcggatcattgtccggtagaactggatacaaaattaccacgacccatgatataatagagtcgtggtaatgttgtagagcaatcctttcttggatggatttttgttgcatgcacaacacctcgattcaaaaaaacgactgctaccgctttaacaaccctacaagcaaaagttataccgtaaattatttctcggcacattaaccacctattagaacaataaccaaatcaaaaactcacaactgtcgattggcagttgtgagttttttgttatcttctatcattgtccaccagcaaaatccctttaaatacgcctccggctgacttaacttcttataatcctgcttggacaactgataaacgatcgtatgcagaatcgggatctgagtcattttgacatttcgcgagttggcatagacgtacagattgatgttaacgtcgtgcgcccgctggtggagcaagtagcggtatttgacccgcagaccagtcggtagctggccattgaccgtgctgcggtcactttgactggttaagttggtgacgcgtttgatttttgactggctggtggtagttaagatctggcggttatgcgcgtcgtagaccgtgaccgaatcctttttagaagcgggagtccctgccgaacacgcggagagcgccatgcctaatccaattgataacatcagcacttttgatcgttgtttcatttgatttaccccaggatttacagaccattattcaaaatgtttcaaatcaatctcattgagtttggactttcgaaaatagaacatcgcgatcagtacgaacaatactaactcaccaacggttgccagcggtgagaaggttgacgagccgacgttggcgaaggtgctgcctgaaaccaagacgatagtagcgtcccaagccgcgtgaaacagcattggaacgataattgatcccgaccgcagataaagggcactgagtaggaaaccgatacttatggcgccgaaaatttgaaccagcgttgatgaaacggattgggacataaaattactgccgtgggcgatcccaaataagatgctggaaatggtcaccgcgtaccaaatcgttttggcttttgaaaaatgaggaaaagatttcaagaggatgcctaaaatcaatccacggaataaatactcttcaaaaacgccggcaccgattccggaaacggccgccatcacgatggtatgaccgctgtgcgggaccagtgaaattaatagcaagtataaaagaaccagaataaatggcaccgaaattaatagcgttttgccaaagttgacagtggctgccaatctgacgggttgcttaacccaataataatttaacgcaaaaaagatcactaataacaaaatttcctgaacagcaatctgtgagatttcgcccatcccaagtgccaattcggttgaataaatcgcgatcaacagaccaaataccagcacttcaagaatggcgacctgccaatagcgatgtgtcactgaattttccaatctaatcatttcccctaaaagttaaataagtattctgacatatttttattattcacaatctatggctggtatgcaagtatcttgacggccgattagggttcaatgacctgactattgacgtagaactttttaccgccaacgtaatagcggatcgaaatggtgacactttcatcatattttttatcttgcgccggattaacggtggccatgtgctggtcggttttggtgatcttcaaacggtagcggtgattgcccttcttggcaacgtgcttcatggtcagaccgctgatttttgacttggtgtagaagtaataggcgttacccttcttcaccaacttttccactttggcagccgaatgcggctctggcatctttttgacccagtagtcgtagccggtaaaatattccaggtagccgtcatcggtcacccgcaggcagttttcgattttgtactgctggcgcagggggaaggccttggtgccctgccagatcagaccaccgatcgtgccggtatacggctgcttgaagtaactttggtaagccggtgcgtggacttttttgaaggtgctggacttggcccagatgccgctggtggtcgtcacgttgtggtaggactggacgacgccctttcgcagtgaccagtgcaggcggttcaaattgatggttaagtagggatgcttggttttgcggctcttggtcaggctgctggatttgaagaccgtcccctttggaatggtgattttgatgtttttatagtgactgttggtggtgtggatcgtcttcttggccatcaggtattgattcttggaaaaatgcgatagataggtgctggcatttgcgggcgctgttacaccgatcgttaagagaacccccagcgcaaacagtccgaattgtaatctgaattttgtcatggtgcttccccccctttatttaaacgtggtcacgctgttattttcataccaagactccttaccaactttgaaaatccaattggtgaggatcttcttgaccttggaggtattcggaacgacggtgatggtgccggcctcggcattggtgatggtcaattggtaatgttgttttgactttttaacaaagggaagctgtttcactcgtgatttggtggtcaaaatcgtctcgccactggccattgggtggctggccttttcgactttcaggctggcggtcggtttgggtgaaactttgaagacaaatggcgaactggcatcgtattccaggtagccgtcggtcgtcacccgtagtcgagcggcagccgaagtggcgtagtcaactggcaaacgggtccctttccagagattgccggtttcggttcggaccttcccctgggacttcttaccgtcggactgggcagcgtagtagctcagataagttggtttgtggatttgcttaaaattgtagcctttggcgcgaatccagcggctgtaaatggttggcttttttactgagagcagcggttttcgaatgttatagcttaaccggtcgacatagacgtcgacatacttattgccatgaaggtgcttggtgccggcgacttgaaccaccgttcctttgggcaaagtgagtttggcgtgcttgttgctattgtatgtactgatggtgcgctgggttttcaaaaagctgtttttgaccacggtggcgtgggctggttgagcctggataaatgttgccccgagcatgaataacgcccccgcaatcaattgagtggttggtttcaatgtagattcccccttggatggcactttagatacgacctataaaattattgtagcattttagacggcaaaaaagctgcctaatcctttcagatcaggcagcttcaagttaaaaatttagttattcatcaatttgtcaatcatcttatccacggcatcaacgtagccggcaagtttcttatcagctgcgtcctggctcttgtcatcgacttccaagtagaacttcactttaggttcagttccggaaggccgaacagccagccaggtttcatcgtccagccagtatttcaagacgttggacttcggcaggtcaatggtcgtctgcttgccatcttgatccgtcaattttgatgactggtaatctgcgtgactcaagactttgtggccgttaaattcagtcagtggattgtcacggagttcagacatgatgtgggccatcttgtctttaccgtcgaggccgtcaaattccttggcgatggtcttttcagcatagtaaccgtacttctggaacatttcttgaacgccgtcgtacaaggtcttgccctgactcttgtagtaggcagccacttcagccagtaacaatacggtctgaatggcatccttgtcacgaacgaacggcttgatcagataaccaaagctctcttcaaagccaaacaggaaggtatgatcgtgttcggtttcgtagtggtgaatggcttcggcgataaatttgaagccggtcaacacgttgttggtggcaaccccgtacgaagcggcaatcttgggtgccaaatcagttgaaacgattgatttaacgatcgtcccatcggctggcaggtcgccggctttcttcttggcagccaaaatgtagttcaggaggacactggcaatttggttcccacttaagagggtgtagtcgccatcaggctgacgaacggcacagcctaagcggtcggcgtcgggatcagaagcgatcagcacgtcggcagagagtttcttaccgagttcgcgggccaaatcaaaggcttgcgggaactctgggttgggaaatggggtggttgggaattcggggtcggcgatagtctgttccaacacgacgacgtaattcttgaaaccagcggcttccaaggcccggcgagcgataattttaccggttccgtgaagtggtgagtagacgaatttcatgttggccccaacgtttttgatcaggtcgtggtcgatgttgacagtttgcactttttccaagtaggcttgatcgactgcttcgccgatcaggttcatgattttagcttcacgcagctcttgttctggcgtaacattgatagcgaacaagtcgctgttcttgcggatatatgaagtaatcagatccgattccttcggtggcatctggccgccatcttggccgtaaatcttaaagccgttgtattgcttcgggttgtgggatgcggtaatcatgatcccggcataggtgttcaaatggcgaacagcgaatgacaactcaggggtagggcgaatgtcgtcgaatacaaagcttgggatatggtgataacctaagactttggcagattcatgggcaaattcttttgaatagtaacgggagtcaaagctgatggcaacgccgcgcttgcgggtggcttcatccaaggtatccataaatgatgccaggccttcagcagcttggcgaacggtgtagatgttcatccggttggtgccggcaccgagcacgccacgcattccggcagttccaaatgagagaaccgttccgaatgcatcctttttttgatctgaatcatttttcattttatttaaatcaagtacaagattttctggtaaattaggttgattggtccattgttggtaagcgtcttcaattttgtcgtccacgacatgaccctccttatatttaaaatcaacctaattatagaaatttaccaggcacacgtcaacaagtttactagccaaaaacgccaatataacggaatatccttgacatatcaaggtaaagaacatatatttattttagtaaattaactaaaaggattcgatacataaattcgcagtatttgtatggaggggtgagatcatggcaacaattaaagacatcgcgcacaaggcgggggtttcaatcaccactgtttcgcgagtgctgaattatgacaaatcattatctgtcagtgacctgactcgcaagaagatttttgaggcggccgaagcgctggattatacaaaaaagaagcggtcgagctcaactcgagatacgatcgcgattgttgaatggtacaccgagcagcaggaactcgatgatttgtactatttgtcgattcggatgggcgtggaaaagcaggccgaacgcgatcattataagatcaaacgttattttgccggcgatccgctgactgcgattgacgacgtgagcggcatcgtggcgattggcaagttcagtgatgcccagattgaggagatgcaggaagtcagtgacaacctggtctttgttgactttgacactttggccaagggacatgattgtgtggtcactgactttgacagctccactaagtctgtactgaaatacttcattgagaatggcttgaagcgcattgggatgatctccggtgtcgaatacagcagtgatcatcagttgaagattaccgaccaccgcttcgatgttttcaaaaactacctcgaaaagcgctccctgtatgatccagccaatgtatttgtcggtgattacaccctccagtccagttatgacaccgttgacgaagcactgaaacggtcgaaggaatcgttccccaacgcgctgtttgtttccaacgacgccatggcagtcggtgctttgaaggcgctccatgaaaatggggtgaaggtgccggacgatgttagtttagtcagttttaacgacaccgcggttgccaagtacgtgatcccgtcactgacggcagttaaggttaatactggcaagatgggcgccgttgcggttcgcttgttgggcttgctggacaataacctggacaacgatgagcacacgccggaaaaagttgttgtcgccacccgattagtggaacgggagagtgtccgcaagggaaagccaattcatgaggcagattaacttgtaaattaacatctaaaatgaccgctaacgttgaatttgcgttagcggtcattattggttacataacattttttgaacagcagattatccgagtaaataggtgacgccggtcgactcccgaccaataaaggtggtcatctccgggttggttggcacgatggaaattggtacaaatgggaactcatcgttgagcatttcccgcaagaactgggcccgggcgttggtgccggaatgcagaatcgttagtttaacaatgcattcgtcgtgcatcgcttgcatttgggtctgccagaattcgttgagcgactcgtctttggaaccatgggcaaccaggtcgaaatcgttatcgccaaatttgatcatgtaggcggtgttggcgtgtttgcccaagaagccgcgaagcttgccgatgatgcgattgttgacgatctgctggttgttgcggaccgaaaagaagatccgggtgcggttacggattttggtgagttggggcaaaatgtccgggatggatttacctgccgcgatgagtttggcagcttccaagacctgataggatagtccggcggcggtcacctggctgttgacgacggtgacttggctggtcgacttgctggcagcggtcttggcattggcgtaagtattcgacagcttatcacttaaatgaatcgagagaatctggctgccgtcagcgcccaactcattgtatagtcgagtgatttcaccgacagagacgtcaccaatgatcggcttattggaacattgatcaaataattgcaggaacttctcgctgctaattttgttgacataaccaaggagcttgccatccataataattggtggattcaggaccgaaattccgtatgcttgaaggtcgatttttgataagtgggccgcagagtcggtcacaagtttaatttgattcatcattttaccccattcctcgaaaaattattatattattattgtatagcatgaataactataattgttgtgttttgaaaaagattagattttaattctaactttattcacaaattagtcatgaaagggcggaattccatgaaaggcaagtacgaagtgaaccaattcatcggcgtcccactggaaaccgatgactccggccagtatcgcatcaaacgcgacgaatccggagactttaagctacatagctggcggaccggcaaacacaccaagggaaagttcaagcaggtcggccagatctttatcaccgagaataatttgatggttggaattatccaagcgatcccagttgcttttaaggatcggcatcagtacacaccactgcagcggtttaccagtgaatatgtgtctgatgaggttttgaatgcggggaaaaagaaactcgaaaaatagtgttggcggcactaattgggggagaatatgatttatctgaaacgaatcttgaaatatattggcatctttattgtgggcgttgtcgtgctgattgcgctcatgtcactgtctcccaaggaatcagtgcgagttagaattgcctttgctgggcacccggcactggcagttaagtgtaatccaaagttggaaaagggctatcgggatcctcattatctgattccatacaagcaagcctacctctctgatgatggttcagctcttttcacatactaggttatttgtaatatgcaagttgctctattcaaccttagtgattttaactttcatggttccggccggaatgggaatattaacttcttcattgagacggtgaccaatgagccccttggcaattggtgaatcattggaaattttacctgacattggatcagcttcggccgccccgacaatttgatacgtttcgggatcttcatcaggcagttcttggaaggtcactttcttaccaaccgtcacctcatccttgtcactatcatttgaatcaatgatttgggcatattgaagcatgtgctcaatcgttgtaattcgactttcaagcatactttgttcatctttagcagactcatactctgagttctcagataagtccccataacttcttgcaattttgatacgttcaaccacttttggtcgttggtttactttcaagtcttctaattctgccttgagtttatcgcgaccatcggcagtcattggatatgtgtcttcagccatttggtaatttcccctttttatctttatattgttgaatcaaggttattcttaatttctttgttgccacgccgcatcaaaatggaacgcattttggttgtcagcaaatcaatcgcgacttggttctccccaccttcggggacgatcaaatctgcgtaacgtttggttggctcgacaaactggtgatacattggcttaaccgtcatcaaatactgatgaataatgttatccagtgaacgaccacgttctttggtatcccgttcaattcgccgaattaaccgaatgtcattgtctgtgtcaacaaatactttaatatccattaaatcacgtaatcgcttatcgtcaaggattaaaattccttccaagatgataacttcgcgcggttcttggtgaatggtctgctgactgcgggtaaattgaccatagtcatagaccggtttttcaatcggttcatattgcagcagttgcttgagctgctcaatcaacagatcaaaatcaaatgccatcgggtgatcataattcacctttttgcgatcgtccatcttcatgtcagcttggtcattataatatgaatcctgttgaatgatcgtgatcgaataattggataattggtcaaaaatcttgcgtgcaaccgtggtcttgccactaccggatcctccggtaataccaataacgactggccgtgttttgtgatttaccatgtaaatagatgccctctcaattagttgttatcggaagtatgcgctgcaatttgctgctgatgttcagcatacgtctttgagtaatatacttttttcgtcttggtattggcaacgaagtacagatagttctttgaacgatccaaaggatgcaggacagcactcattgaactaatgcttgggctgtcaaatggtcccggaccaaatccggtatacttataaagattgtatggcgaatcactctgcagatccttgttcgtcaaaactttgttatttcggtgaatggcatacaaaaccgcgacgtctgattgtaatggcatgttgatatcgatccgattcaacaataccccagccatcttccgtcgatcggtctggttgacaccttcccgttcaatcaatgacgacaaggtcatgaactgctgcatgttcatcccggattttttaatggcggcaaagtgcggcgaaaccatctgattggtcttggcaaccatttggttaaccagtgacttcagcgacgtattcttttccacctcataagttgcaggatacaaatagccttcaagacggtagcgaacgtttttggctttcatcgccggattaagcagcttcggataacgactggccagttgttcaaggtatgtctggttcttcattaatttcaagaaatctccacgatcgaaatcagttgtcactgaaatctgggtcgcaatttggtcaatgttggcgccttctcgaatcaaaactttccccttggtgctttggatcggttgatcagtcccgccgcgttgaagccgtttggcaattgttttgaggctcatcgagggttttagttgataatacccagctctaaagttggccatgttgttggatttgacatagtaatcaaagaccatgccacttttaacaatttttttattttgcaggatcgaaccaatttgcttgttcgaagcgccaagcggaatgtgaacctgagtgacgttagtgttctgtgggttcagtggctttaaggcatcttgaaaataccggtagcccatcagcccgattgttgcagctaaaataaccagtaaggtaatgacagaaataataattcttcgcccgaggcttttattgggtttggggtttcgtcgacttgagtcatcgctcatgagaagctcctcctatctgttcaatttaattatagtttccaaattatctaatttctgcatttaaatcagctgttaaccgttttttaatcttttcaaaggcggtgttgaccacttcgtccttcagggtttcgcggggatccacataagtcagggagtaagccattgatttcttgccgtcgggaacattgtcaccttcatagacatcgaataaacgcacatcgttcaagaaggcaccaccacgtttattcataaccgccaaaatttgactgttggtaacatcctgatccacaactaatgaaatatcccgtttgattgatggatatttggagatagcttggtattggttgtcatcttttggcaaatcaatcaactcctgcatattgagttcaaatccataagtttccttgattttgaactgcttggcaattcgtggatggatttggcccaagaaaccgacgtaatggccgtggatcgaaatgttggctgtccttcccggatgcatttcaggatattgatcagtggcagtgtactcaatgtcacctttgacgcccaaattaaccaagaactggttaacaatgccttttaactggaaaaagtcgaccggcttgacatggttattccacagaggatcagtgaaattgcccgtgacaactccggcaatgtgttcaacttcttcaggccgaatttggtccgcactatctttgtaaaagacccgtccagactcgtaaagggccacatcgtcaactttgtgggcatggttataggcaacgtcatcaagtaatcctgacaacatgttcattctcagcaccgcatgatcctgggtcattggccagagcagcttcgtttcttgactatcacgcatcaaaaacatttttgctttttcagcagtagtcaaagaataagagatcgcctgagtcaggcccaagccttccaaggcagttctggaagcgcgctgcagtttttgaatcggcgtcaaaacaccaatactttgccgtccggtcggcagcgttgccgggagattatcataaccgtaaattctggcaacttcttcatacaagtcagcatcgcggaaaatatcccaacgacgagccgggatggtcacatttaaaccgtcatcgtgggcttcgcttgaaaagccaagccgatcaaaaatacttttaatttctgcggtggttaatgaagttccaagaacatgattggttcgttcagcggtaatataaatcgttggcagtttaggatgatattcactggcagtcaccgtgcctttggcgatcttgcctccagcaagctgcttaatcatgctgacagcttcgtcaacagcatcttggacaccgtctggattaattccccgttcgaagcgttgggaggcctcagagtgcaaattatgccgttgggcagtcttacgaatcttgaaggaatcaaaaatcgcggattcaatcaccacgttgctggtattgtcatcgatttgggtgttgaagccccccatgacaccagctagggcaatcggtttgtcgtcatcggcaatcacaatatcgtctgcggaaagctcgtgttcatcctcatcaagcgtggttaatttttcacccttttgagccaggcgaacattgacgttaccgttaattttatctttatcaaatgaatgcaatggctgaccgtacttgagcaaaatatagttggtaacgtcgacgacattgttgatcggtcggatgccggcgttccaaagaacaatctgcagccaagaaggactcggcgcaattttgactccttcaacaacccgcagcttgtaggttttggcaagttgatcgtcagcttttgcctgaatttcttgattggcatccaatgaactgtcttcatcaaccactggttttttaatttctggttgctggttatagattgcagccaggtcgtgaacagtgcccaaaatgcttaacatatcaccacgattgggagtgacatcaaggtcaataatgggatcatccattcccaagtacttgtaaattggttcaccaacaggcacatcgtcatcaaaaacgtaaataccgtcggcccattccttagggatgacgtctttgctgaacccaatttcatccaaggcacagatcatgccggatgattcaattccgcgcatcttggaacgcttgattttaacgttgccaccaattcgtgagttgggcagcgccacgataactttttggtcaacgtccacatttggagccccacacacaatttgtaagggttcgtcttctccgacatccacttggcaaacgtggaggtggtccgattccggatgtttggtcattgataaaatgtggccgacaacaagctttttcaagccgtcttcggcaacggtgacagaatccacctcaaccgctgttcgttcgatcttttcagccagatctttagcgggcatattcagatctaaatattgtttgagccatttatatgaaactttcattctctaattacccctcttactgaattgatttaagaagcgaacgtcatccaaatagaaatcacggatatcgtcaacaccatatttaagcattgcgaaacgatccggaccgactccgaaggcaaaaccaccatacttcttggagtcaacaccggccatgtccaaaacatttggatgaaccattccggcacctaaaacctcaatccaaccagtgtgtttgcagacatcacaacccttacccatgcagttaaagcaagtgacgtcaacctccacagacggttccgtaaatgggaaataacttggacgaagacgaatatcgaatttatcaccaaaaatattttgggccatcgtgatcaaagtacctttcaaatcggccatagtgacgtgttcatcgataaacagcccttcaacttggtggaattgatgagaatgcgttggatcatcagtatcccgacggtaaacgattccaggtgagatcatcttcagcggtccctttgaaaaatcatgtttctccagtgcccgtgcttgcattggtgaagtttgggttcgcattaggatttccttacttatgtagaatgtatcctgcatatcccgggctggatgattcttcggtaagttcatcatttcaaagttgtacttatcttcttcaacttctggaccggaaaggacttcatagcccatccccaaaaacaaatcgacaatttggtcaatgatttgttgaatcacgtgcggctggccttgtgcgaccggccttccaggcattgtcacatcaatcttttcagctgcaagttgtgcattgagggcagcatcttccaatttttcacgatgatcagaaacggcttcggtgatggcatcccgaatcttattggcataactgccgacttccggccgttcttcaggggttaattctttgattccccgcaacgcagcggtaatcgggccctttttgccgagtaaatgcactcgaatttcatttaatgtttttaaatcactggtttgctgaatatcagcaagccctttttctttgatctctgtcaattgatctcgcagtgacatagtatccctccagttcaaattttaaacacaaaaaaactccgcccgataagggacgaagcaacgcggtaccaccctaatttgctgtcaaaagacaacacacttaagacatcgctaacggtgattaaccggaaattttttgttaaataacgcccaatttcagctcgaaaaatgaattcgtgaagatttcctacttcgttctcaccaaccacgaagtctctcagataggttatcaacctactacttttttctcaaacgctttacattagtgaataataagctaaaacaaaaaaatggtcaagctacttttcaacgcttggataccatttttctgaccatgtatgaatttcatgcatgattggagctaattctttgccttgttcagtcaatgaatactcaattaaagatgaatcatcgtgttcggttctgacaacgacaccatcgtcttccagttcgcgcaggcgctctaccagtacacgatcgctgcacttggggatttgtcgggcaatctccctgaatctcaaaacaccttcctgaaggaggacgtcaatgattaagccattccatttttttccaaggaatgaaaatgtcttctcgaacttgggacacaaataataattaatggcatcttgcagaccaactacttgtcgcatataaattcccccctctcatcggacaaccgctatttaacagcagttgttcgcttaacttgcttctttaacgtttcaaactttgatttaagtggactcacgaattcgtgaacagcttcgtagtcatcgactaaggagacgatgacactttcttcgtacttgggccgtgccaaagttaatccccacatgtgcttaagaataatatctttttccattggggataacttggtgatccgttcggcattccgcagggcgacccgtgggtgaataaatgcgtgagaacccaaatcaaacttggtggttctccagtcatagaaaaacagatcatgcagcagaccagcacgcgcaacggcacgataatctaagccccttcttttggcaatcttataactgtcaaaagaaacagcaattgaatgttcaagtcgagttgagtgatggtgctgagtatagttagccaatttcttaaccatgtcagtcgccatcaggtcagaaactatttcacgatactcggaatcgtttttccattcatccttttgcatgtaatacccctttgtctttatttacaaatatgatacatggtatcgccccaaatatcaatgaaaacgaccgttatttaacaaacttgaaaagtaatatgccggtcgctacggcaacatttagcgattccgcctcaccattcattggaatgtaaaggttttgatcggtcttttccaaaatctttgggtcaaccccattaccttcatttcccataatcagtgcaaattgcttggtaggtgttatatcatagtaggaaatggcctgatcatttaattcggtgccataagtcttaacgccagcttctttaaaggctgccatccattccaagatatctccggtaaacagcttcatgtgaaattggctgccctgcattgaccggacaactttcgggttataaagatcagccgatcccttgccaaagacaatgccgtttaagcccgccgcatccgctgttcggaccatggtgccaatattgcccgggtcttgaatgttatccaataacagccaggcaccctttaagtcatcgggaatctgttcatggtagtcctcggtattgagcacagcaaacacaccctggggcgtctctgtggacgagatatgtttggcaatttctggtgtgattaagaaaatttcggtatcatcgtcaaccggcagatcgcccaaatagctttcgtcgacaaccatcagttgtttgatggtctggcgatggcgaatcgcttcatcaacaatgtgccagccttcaataacgtattcgccggacttaacccgtcccttcttggactgcatcttggtccattcttttacccggttattctgattcgatgtaattctttcaatatccataaaatatccctctttcattattaattgtaggtggtgatcatttgaacgacaaaattcaaacagtcaaaatgaacgcttccggccgagtccaaggcgttggctttagatggtcaaccatccagctggcagaaagcctcaatatttccggctgggtcaaaaatgaaatcgacggcagcgtttcaattcttgcaagcggcgaaagtgaaagtctggcgcaatttatccaaaaaatcaaaaattcaccaaccccatttgccaaagtcaaaagtctccaagtcaattatatcgcgaaaagggtaaataaagggtttaatgtgaaatattaaatttaattgtagaatatatttcgttaaaggtcaacggcctatcgaaaatttgtggttcgttatttcacaatatggacagttttacgctgtctgttcatttaaacgatcgcgacaacgaaaatgaagtcctgaaataaagcctttatttacaaaggattgtgggttaatttaggccttaaaaaaggtcgaacttttttgttgagcctatttacatatttttcacaaggtgttaggatgaaagcggtttaagaatatgaataatcattggaggaagaactcatgaaagaaaattttgattttttaatgcctagtgtgaacttttttgggaaaggtgttattaaaaagattggtgatcgtgcgaagatgttgaacatgaagaaaccgttaatcgtcactgacaagtttcttcggggaatggacaacggtccggttgctcagacactggattcattggatgctgccggcgtttcatacgtgatctttgatggtgttgaaccaaatcctaagattcgcaatattcaagctgccaagcaagtatatttggacaatgattgtgacagtattatcacggttggtggtggttcttcacacgattgtggtaaaggaaccggaattattttgaccaacggcgatgatattaccaaattggccggaattgaaaccttggagaatccattgccaccactgatggctgtcaacacaactgccggaactgcttctgaattaacccgccactgtgtgatcaccaacgaaaagaccaaattgaagttcgttgttgtttcatggcgtaacattccgctggtttccttcaacgatccgatgcttgaattggatgtgccagccgcaatgactgctgcaactggaatggatactttcgtccagtcgattgagccatatgtgtcaaccaaccgcaacgaaattaccgatggtcagtgtattgaagcaatcaaattatgtgaggaaagtttgcgcgaagctgttgccaacggtcacaaccttgaagcccgaaccaagatggtcgaagctgaaatgttaggcggcatggcctttaacaatgccgaccttggctatgtccatgcaatggcccatcaactaggcggccagtacgatgcgcctcatggtgtctgctgtgcaatgctgctgccaattgttgaagagtataacttggtggcatgcccagaaagatttgctgaattggcaaaagcgatgggcgaaaataccgacggcctgtcaacacgtgatgccgcagaacttgcgatcaaggcaatgcgtcaaatggccgatgatgtccatattccacgcagtatcaaggcaattggtgccaaaccagaagactttgaactgatggctgagaatgccttgaaggacggtaacgctttctccaacccacgaaagggtactaaagaagaaattgtccagttgttccagaaagcttatgacatgaagtagagcgccgagacccgggtgacccctgagcataagcgaagaatcccaatgatgaacggttcttgttcatcgttgggatttttcgtttatgcggctggggtcagggtcgtcggagcgtgttttcaaggccgaagggattacaaaatggcataacaaactcgccagagcgcgacgagacccaagtgctcccaccaagtaggctagaccatttccgcccgtcaaagtatatttcgaggattcaaaagttgtcttccggatccacaaacccaaaaaccttccaacaatcttcacactttcttcacaacttggcgagaatattaagataaaattatggtgtagataagatattacccaaaagaatcagaatcaattttcaatattggagggcgtttattatgaaaaagtttgatctggccgatgcagcactgctgctacttattccattgacgatgatcggcttctccgctagtattcatacccgtgatcacgatatttctaccaccaaggccgcccaggtgaataagatcggtgaaaatatcgatacagaatattcgggtgattccgacttaaacaagggcaacatcagaccgctgtattttcagccgtcgcgggtttttagcgtgaagtaccggacggttagctttaaaacggttttggacgaagactaccgggaagaaaaattatatcgttatgttccgggggctaagaaaaacaatcgcacttatcgttggtcaaccattaaggcccacaccggcaaacgggtttacgttgataaaaaggctaaagcctactatcgggacgatgatggcgaacgcgaaagcgaagatttctaccggatccgcgtttctacaaacaagcatgcgacgcgttactgggtcaatgaagatgcgattgatgactgatttttaatatatttgattggattggggtgagtaatccctgccaatctggcaatcaaaaaatgaccaattatttcattttgaaatggttggtcattttatgtgaatgatgaatcattttgcggctgattatgataaattagacgtataaattcgcttaactggaggtgcaatttgaagatactagtaactggtggtgccgggtttattggatcaaatttcatccattatcttctcgaaaatcatccgactgatcaggtgaccaactttgatgccctgacttatgcgggtaatttggcaagtttggcggatgttcaaaatgatccccgataccattttgttcagggaaacatttccgatcggcaggcggtcgaacaagttatttcaacctatcagattgattcagtcgtcaattttgcggccgaatcccacgttgaccgctccatcttacatcccgatgcctttgtccgcagcaactttgtcggcgtcagcacattactggatgtggtgaagcaacagcacgttaacaagtttgttcaaatttccaccgatgaggtttatggcagctcacgggggcatgagcagttcaatgaggcggcacacctcaatccaagttcgccgtattcggcgactaaggccggtgccgacctgctggccctttcgtactacaagacgtacggcatcaatgtgtcaattacgcgatccgccaacaattacggcccgtttcaattcccggaaaaattgattcctttgatggtcaccaatggtcttcggggaaaatcactgccggtttacggtaacggcaaaaacgtccgcgactggctgcacgtgtttgataattgtcgcgcgattgatgccgtcttgcgtcatggccgcccaggcgggacttataacattgccgctcacaattacgcagaaaacattcaaattgttgaaaaaattgttaagcagttggaattgcctcagtccatgattgactacgtttccgaccgaccggccaatgatcagcgttactcaatcgatgatgcactcattcgcaatgaattaggttggcagccgaccattgattttgatcagggcatttcccaaactgttgattggtatgcgacacatgaaaagtggtggcgaccgctgttaggcgccgtccacaacagataatggggtgaaatcatgaaaatcggttttattggtactggtgtgatgggcactgggatgattaaaaatttactcaaggcgggctacgacgtcacggtgtataaccgcaccaaggaacacgccgaggatgcgcttgatgcgggggccacttggctgggtacgccagcggaagtgaccaagaacagtgaggtggtcattaccattgttggttttccaaaggatgttgaacaagtctattttggtgacgacgggattttaggcgttgcccacgctggtcaaacgttgatcgacatgacgaccagctcacccagtcttgccaagaagattgccaaagctggggaagccagggacattggggtccttgatgcccccgtttccggtggggatgttggcgctgccaacggaaccttgacgattatggtgggtggctctgaaagcacatttgagaaatcaaaaccggtgttatcggcaatgggcagtacgattacccggtttggcggggctggtcaaggtcaaaatgccaaaatggccaaccaaatcatggttgccgggacaatgaccggaatgatcgagtcacttgaatatgccaaacatgccggcatcgacctgtcccagatgattcgaacaattaatggcggggcagcagcaaactggagcatgactaattatggcccccggattcttcagggggacttccagcctggatttgcggccaaacattttttaaaggacttgcggattgcgttggatacagctgatgaaatgaacattaatttgccggcgactaaagtggctcgggacctctacgagaagatgaccgacgagttgcatttaggtgatcttggtactcaagggttgcttaaggtttatgaaccagataacatttaggcgcaaaacggggctggaacaaaatttttagttttgtcccagcccctgtctatccgttcgattatttttgctgatttttgcgttcttttctgctttggttggcagaaaccaggttgatgataactgaaaccaacaaacaaattcctgctaaaataaccaatccgattttgacatcgtctggaaatgatgacttttgaatgaagaaggccaatgcaattgaaatcacaagggcagcatctgccacgatcagtttcggcgaaaatcccattgtactcacacctttcaaaaagcattataacaaatcggctgtccttgtcacggttatttgaaaattttgtctggcaggccaaagttgatataataagattataaatgaaggttaggtgaagatcatggcagaattggacagtaacgacgcattcattgatacgaacaagttaatatttggcattggccaggtgcaacagatcactggggtttcaggaagacaattgcgttactgggaagaacagggctacattcaatccatcagccaaaaaaagggtgcagcacgagaatattcgctgcacactttattctttatctttcacgttactcgatttctgaataacggctttactcttcaggcagccgttgacagagctaaaaaatttgatcgccaattgccggtccttcgacaattcttgcgcgcccaactgcaaggcgtcaacattgatgatgaccaaagtgttctggatttcggctatgttgattcctcacacacacaacgaatctatggggttgttaaagatggtgagacgttctttcaaattgaaaatgttgattaagcatcacatcacttatcgaagcgctggctgtggccagggctttttattgtgcgctcaatcaatcgtcttcgttatcgaatttcttatataagccaatgattgtcttatcttttaattcgactggcttaccatccaacgtgacgtcgacaattttgtaatagtcttccaggtcagggacctccaaacgctgattggccagaaagtcggctgcagacttgtattcaatggactcggtgccgccgccattttcgtatttgatttttaacatgatgccactttctttctatatagtttaactaacattgacaacttaattttagattgaacatttttgaaatacaactaactgcctttatgaaatttctgtgaagaatgtttgtcttttttgagactttaaattcgactgaaaaattgggccatgatatattattgatgaggggatggctgtcgtaacatcctaaaatttaatattgtaatgacgacgtttaattagggggaattgaatgttgaagtttaagcatatttttgttcttgtgttaaccacgttgattttagtgattagcttttcggcatttggcggtcaatccgcttcagcgcaaacaatcaagtttaccagcgcgatgcacaccagcaagaatttgacttacaacggcacaatcaagtactacgttaaagcggacgcaaaaaaatattcacctgaaatcacctatgcaacccaaaaatggaataaagcccttggcaaaaaggttttccaacgaaccacttcaatcagccgttcccgattggtcttcaccggaactaataagcttaaccggaattacgcgggggtcgcagaaattaatagtggcgtgattgcattgaacacctcatggatgaatcgatacaatcagcagaagcgccgggcagtgatcattcatgagcttggccacacgtttggcaccaaggatttgtacaattatccaaatggggcactgcgaagtttgttcaagcagcagacgatcatgggcggcaactatgccaccagcattaaatcgtttgatgccaaattagccaaatggactttgcgaaaaaccagaagcatgtctcaaaccgagtttcgccactatcgttccaatacgggactctactaccaacagatgcttaacggacagctttaatttctgctgagagaccattgacaagcgattgtccaaacactatgattaacttattgttttatagacgttgacgcagtccggtagtcgattaacttgagaagtcagaaactcagcggtagatgtgagctgagcggttaatcgacgaacatacagctgctgagtcttcaactatgtgagacggatcatctcgttaccgatgaattgagtggttggcgatttttcgccagtaacttgggtggtaacgcggaaaacttttcgtccctgacaattaattttgtcagggacttttttatttaggaggaattatggaatgaacattttggaagatttgaaatggcgtggcgccatcaatcaagaaactgatcatgaaggcttaaatgaattggttaatcaaaagtctgtcgggatttacgtgggaattgacccaaccggcgacagtatgcatattggccatttgatcccgttcatgattttgaagagattccagctggccggtcatcatccagtcattttgatcggaagtgggacgggctcaattggtgacccaagtggtaagaaatctgagcgggtccttcagtcgatggataaaatcaagcgtaatgaaattgcgctgactgctcagatggaaaaattgtttggagaagacggtaagtttgagattgttaacaactacagttggctgtccaaattgtcactgcttgattttctccgcgattacggtaagttgttcaacgtcaacactatgctgaataaggaaattgttgctagtcgtttggaagtgggaatttcattcactgaatttacctaccagattctccaggccattgattttcttcacctttaccgacacaatgatgttcagcttcagttgggcggggctgaccagtgggggaatattacctccggaattgatctgattcataagatagaaggacccgatgccaaagcctttgggttaaccattccactattattgaagtccgatggtaccaagttcggtaaatcagagggtggtaatgtctggcttgatcccaaaaagaccagtccatacgaattctatcaattttggattaaccaagatgataatgatgttatcaaataccttaaatattttactttcttgtcacaagatgaaattgccgacttggaaaagaaagttcaaactcaacctgaaaagcgtgaagctcagcgtaaattagccgaagaagtgacggagtttgttcatggcaaagaagccgttaagcaggctgaacatatcactgcagcattattctcaggaaatgtggctgatttgacgacaaccgaaattgaacaaggcttcaagaacatgccatcagttgaggtttcatcagaaccgttgaacattgttcagtggctggtggatgcgactaagattgaaaagtcacgccgtcaggccagagaagacattaccaacggtgccatcagaattaacggtgaacgcattgaagatgtgaattacgaaattaatccggcgaagaagtttgatggcaaatttgtcattgtccgtcgtggtaaaaagaagtactttttagcgagagttaaatagaagcaaagacagatcgaacgctgatctgtctttttttagttgacaatgttcatcaaagtcggtatattatttagtgcggcttttgcgagaatgacttcttcgcagagttacaaattttaaaaagtcattgacacacattgcgcgtcaatgggtctgccacaaggagctgtcctaaaaaagtgagcggattgtggcgtttagtcctatcgagataagtgtgccggtcgagcgatcgtgatcgcgcgtttaggcatggttatctcgatgggtctgccacaaggagctgtcctaaaaaagtgagcggaacaaggcgctttgccacataatcataagtgagatggaggcgggatcgtaatcccgcaggaatcttgcttatgattatgaggctgcctggtgaagctgtcctaaaaaagtgagcggaacaaggcgctttgccacataatcatcatttttgcacttttccccggacataatgtacgaccaacgttatcaaaacagcggccacaacaatgccggcaaaaatcccagacggaatttcccaaccaattaatggaatggagacaaatagcttaattccaataatcgcaattaaaaagtaagccatggtttccagctctggtattttacgcatgacattcataatgacttctgcgattccccgcatacacaaaattccaatcatgccaccaagcaagacgataacaggattagacgaaattgctagtgatgccaaaacagaatctactgaaaatataatatccatcatttcaatttgaagaactaccgaccaaaataacgataagtgaccttctttttttactgtaacctttgaagaagactctttcttcttttgtttgggcgcaaaatagcgatacaccatataaaggagatagagtgccccaattatttttatttcccagatgtgaatgagatacgtaccaattccaatgactaagaaacgaaatatataggctccccaaagtccataaaatagagatttctctcgttcttttaagttcgttaaagcttgtgtttgagttgccaaaacaactgcattgtcaaccgacaataaacattcaatcatgatcagtgacaaaataattatccagtcactgctagatgttaacaccgtttcccaattatgcagattaaaaaaagggccatatagttttgaaagtaattgcatcgttagtgctcctttccatgcataaaataataccacaaccaactcaaaccaacgtaaatattcttcaatttaaactttcttttctttcctacatagacgcacggtccacgatggactaaaattagcttaaatgaactttagaaatttccagtgaggctacaacaatgatttccgaaaaaaagattaattcacagcatacctgggtcgccattaaccaaccgacgcaagctgaaattgcaaaaattattcatcattatcaagtaactgaagaaatgttaggttatgccattgaccctaatgaacgcgctcggattgaaactgatcgtgatgccaacatttttcttatcatttttgatgtcctatcaaaggatatcaccgatagtggtagtaccgaaccaattgggattatgttggttaatgattatattttgaccttcacgcgaacttcaaccgaatttgtagagaagctctttgatcaacaactgtcttctgctttggcccatgctaaaaatgaagtcacgcctttaacaattatttttcggacattatacaaactatctgtccaatatttcgacgctgtgaccaacattaatcggcagcgacaacagattcaaaaaaccatgcttcatcgaatttctcgccgttcaatttcagatatgcttcatcttgaaactagtttggtttattatttaacttcattgaaaacaaataatgcccttttaactagtatgaatcggatgcaagagattcaaatgaccaaggatcaacacgaacaacttgaagatgtcatagttgaatcccaacagggagaagaaatggcccagttagcaacagatattattgaacgggttgcaagcgccaattcaaacattttggacagtgacctaaacaatacaatgaaatttttgacagtcttctcaatagtcctagctgtcccttcaattgtttttggcttctttggtcaaaatgtgttaattcctttcagtcattctgttttaggctgggagattaccatttttattacaattattttgattttaattgttcttttagttttgaacttcaataacttttttaaaaaataatttttgattaaaagcgtatttaattcatagagtttgatttagcgctgattctggcaattttcatatgttaaacttaaattaataaatacgtaattacataaggaatgaaaatatgatgcaaaagaaaaatacccttcaaatagcaagtttaatcacctggtttattctcttggtcggtatgattattttgctgcccaactcgttaagctggaattccagctttagtcaacaattgcctataaaggacgcccctagtgccaccatagtgtacacaaattcaaatggtactctaagtacaaagcagcggaaagctattcaagaaaatcagaagaaactaaaagctaaccaaaagtttctaggacttaaatcaatcgaagctggaaatgattctaatgccgcccatcggctaaactcaactgataagtcaacggaactcagtattcttcattttaaagaatctcaaaaacagtttcatatcttaattccccagatttatagcttaatccaaacaacgggagttcatgcgtacataactggtaatgatgtgcttcaaattgcccgtgtacaggctacgcaggcggccaataagcttgtgattgttattagttgcattctcgttgtgctcattcttggtctaattttccgttcggttttggtgcctttaattaccctattactttctgggattatttatctatcaagcttttcaatcgcgacactggcaactcgcttcttaagtatgccttacacagcgtacacgaatacaatcatactagtggtaagtttcggtttatttccaatcgctgcaactgttttttatcgtttctattgtgaccactatgaaaatcagaatgcagttagaaagagttattgggattcttggctacccaccttacttagcattgtgccaataattgcgctaagtagtttattgcttttagcaagaaatactactctccgttctctttggatactatccgtctccatcactttagtttggatagccttttacaccttgatgccggctttcaccgaatttctagatgatctgtttttctggcctggaaatggaaaaagtcttaatcctagtttcagtttctggcattcaagtgctattttaggtaaaaagcgttccctaattagtttgataagtattttcattctcgttttgctagtcagtttgattaaaatgacaccgttaaactggtccagcgcggttaacacaccattcttaagtcaggcaaaagttggcgcgtcggtgattactagtcactatccagttggtaaagtctcgccaatcacaattacgctcaccaacaaacaaccaatcacaactacaaaaaatatggcaactctcaatcagctaacacaaaaactaaaggcaaataagaatgtggccaacgtttattcagtagcccagccaagtggtatttcactgaccaatttgtatgtcaacaagcagctagcttccgttaccagtcaactttcggcggctaatcttaatttgaccaacactcaaaaatctctaaaaaaatcacaaaaacaattaaaaaacttaaatctaacttctgcactcaagcagttatcaaaaaatgcgactaatttgagtaaaattcagtcacaaagctcacaagttgccaatcaggccgacgaattaaccactgacattacaactatgcagtcgcaacaagctgaaattgaccgcgcaattcgttcgggaaagacttctagaaattcaacaggcattcaacgggcgttgtcttctttgagtacccacaataaaaacctgattagtgacttaaaaacactacgtcataatattggcgtggttagttcgaataataacgtcatcgccgacaacatttctcaagttgaagatgatcaacaaagcgttactgatgattttgataaagtccaatccgtacttaaaactaccggtgttgccctaacaaaggacagtaaaaacgtccaaattgctcagcagaacttaattggggaacaaagttacttagataatttgagtaaatctggaattcttaacgtgctctatatgacttctgtagatttaagaactgatccaatgaaaaatgcacttagtcaattcaatgaatctaacaataaggaaaccaccatttcagttgtactcaacaaaacaacggcttcaataaaagcgaccagcactttgaaacaagtacaacaactgactaatgcaaccttatcaggaacttctttatcgaaaagttttctgcactattcaggagaaacggttgatgtggcaaaacaacagcaggctttgaatcacgatctcactcatctggttccatggctaattggtttggttattttgtatcttttgatcatttcacaatcgttattcgccatttatgcaagcatcagtctcttaattacattttggggtggtcttcaattaacaaattggttctcaaacctacttttgaaaaccccactgttagctgatgttcccataatttctggcttgattgtaagttgcttaagtctgggaattcttatccccataattttgagaacaactcgtgcaactactgataattacttaagcgcaattaatttcttcgacccgttactaattttaatcggtattatgactttaattccactactagcattagggtttacacaattactttcttttattcaaattgccttaatcgtatttatttctcaactggtttggggattactctttccaattggcatcacagctgcacttcacctatcctatgataaaaattaaagtttccatcacaaaaaggcatcgccacttaaagcgatgcctttttaattacccaattttcttagctctttttctttgtaccttaagttccatcacccaagtagtgacaggaattgtcaaaatcacaccaataaacgaaattaaaatcattagtaactctgacacaaaaatcttattattcacaaattcgccccacgtataatttagccgttcaaaccagatgaacaatcctaaaaagccaccaaagaaaccaaaaaacaacgtgttaaacgtggtaccaataatctgtctacccacagacataccatctttaaataaacgagttaccggaatttcagggttttggatcagaatttcacctaacccggctgaaattgcaatggccgcttcggcaatggctcccaaactacttaaaatggtggttgcaatcgacacatccaaaaatttgattccaaccagtaatgacattccttcaaggtcttcagtattctcattgccaaatccttgaaccacagcccagtgctccattggaatgatgagcaaaaccaccaacaccataaccaaaactgacccataaaaagctgtttcagttgttagcggatcatcatcccctaaataaattgtcacagccaggatgatcacggcatttaataaagttattcccagaatcggaaaattgagtccaattaaaacgaccgtcataaaaattaaggcaaagttaattaccaaactcagaaatgactttagtccttgtaacccaccaaccaaaaccattgccacaaagagaatcagcaccaacactgaaattgtgctcatgcgcggtcacctctttttaataaactacttgcaaaccaactggcagcagggatggctaaaacaataccaataccactaaccaagctttgaaccattcctaatgacatattcatggtgaaggcataaccccagctatcgccattgcgtaaataaagcaccatcatcgcaaaagtatctgccataaagattaagaaaagtacattaatcaaaggtcccattatggatttaccaatctcccggccagatagaaacaactgacggcgcgtcaaatcaggcgtttctcggtggaccgcaaacagactagaaattatatctgtggattcatccataactgcacccaatgaacccaaaattgtttctgcaataaacactggtttaagactttgagtcacatactccattgtttcaaaatggagtccttgatcatgcgttagattgagaacaattaaagttactaacaccgatcccaatgttcctaaaatcgtcgctccaaaagtaaccaccatctgcttggttttaccaagcactaaaaatagcgttaaaccggcaaatccaaaggctaaaactccaaaaatttctaaaacgttggtgccttgcaataatacatcgagtttaattgccaagaaaaataggacaccgtttagtaatacgcttaaaagtgccataaatccgctaattttcatcgttagcaataataggctaattgccaacaagcttaaaaacacaattgacgtgtcgcgtttcaagtccgtaatcgtcgcttgtagtttatgatccgactttttttgcacagccaaaaaaatttgctggttcttacgatatgcttgatccattgcgttagaagcagaaaacgtgttctgaacatttagtgttttgtttcgatactgtccatttaaaactcggacttttaaaatctgcttttgtgaataatcgtgattatgaaaattatccacctgcttaatccttttttcgttagtcaccttaatgatctgaccaactggagctttatacaaagctgcattatgttgtgtggcaaaacacagcaacccaccaatcacaattacaaataagatcgtaaaccaactcacctgatatctgggttgaactttactcacaatacattcatctcaatcctaaaactttacttgattttcttgatcattttatgatgggcaattcctgcttccatcacttgatcgcccacaaccttaaatccattttctaaatagaatttttgagcgtggtcttgagcaaagagccatacctgagccaccttgttgcttttagcgtctttttcaatcgcactaaaatttgtgaagacaggtcctgctgtcgatattctttgagcgtacaaacccgttgcaccaaggttccctccttcgttgcaatgacccttgctgtggttactggtttgttttcgatgtagccgacataatacaaacatcggttttcattttcatcctgttcaatgctagcatcaattttctgctcatgaataaacacagccgtcctgattttcatactatcatcatagactgcattaccgttaccaaacgctgtttttatttccataatctatcacctatcaaaaattccttttatttttgaattataaaccctttgacggtctaaaaacaaactcaacctaaatttaagcattttcttaataaaattatgttaaaatgactttatatttgtgaatcaaatcgtaaggaaaaaaagatattcacaggaaggttagcaatcaaaaaatgaagcaatttatttcaaaaatcaacacccgaatgggctttttctttcttctagtattccttttctggttgaaaacacttctcgcctatttcgccgatttttctttaggggtttccggcgtttttcaatggtttatcatgctaataaatcccttggcaattaccttcttactattcggccttgcgctgtacgcgaagcgagccaagtttttttatccactgattatattaattgattttggaaattctcttttactttatctcaatgtcatttactatcgtgaattttccgatttcatgacaatcaatacaatgctagggtattccaaagtagatcagggattaagtgggagctcattagcgctaacgcagccccatgatttgctattttggttggacctcgttattattttcagctatcaatttgaggttgttttttttcagcgcaaaacttctcaaattgtttttcacaaataagattgctttaatgctacactgaatgtaagcgtcacctttaattaaacaaaaaacgatgaaagcgtgattttgtatgattcaacacatttttttagacatggataatactttactcagccctgacggatcaatcagtgctaaaaatatttcggttattaaaaatagtcctattccagtctccttggtttcggcacgagcaccatttgaaatgcagtttgccattcacgaccttgacttgaataccactcgagttgcattcaacgggggcttaatttacaagcctcagcttaaaggctaccaacaaatctattcacaagctattaatcctcaaacagttaaaagaataatgacaattattcatcaaaactttcccgaagtatccttaaactggtattctgatcacacttggttcacagataaacattgccaagaaactgacgccgaaactgcgatcactcatgaaaagccggttattcagaaaacctctgtcaatctaactcaaacaatctataaatttatggttatgagttttcagccgcccttatttgatcgtttacaaaagtacttaaaaaaattaaacttaccagatttaaatgtgatgacttcaggggatgcttatatcgaaatcaccccaaccagtgcgactaaggccaatgcaattgctcaaattcaaaaagaagaacacttgaaaattgaccaattggcagcctttggcgacggagaaaacgatattcccatgtttaaacacgtcggtttacccattgcggtggcaaatgccagttaggaagttaaacagtacgccaaatttgtttcgaccagcaatcgcgaagatggtgtcgcaattgggattgaacaacatattttagctaagtaatcaaatcagcacttaaacttgactttgttggtcggcgtttaagtgcttttagttaatctaaaaatccattgaaatctcggttcgcatttttgggccaattaatctacaattaagtaaataattaaagtgagatgatattttttatgacaaaacgtattaaaggttcctgtaccacaattttagtcggtaaaaaagcttccattgacggttctacaatgatcgcccgtaacgaggacggagccggtccacttaatccccaaaagtttgttgtgattaagcctgaggatcaacctaaacactacaaatcagttttaagccccgttgaaattgatttacctgaaaatccattgcgttatacttcgactcctgatgccacagatggccgcggaatttgggctggtgctggtattaacagtgacaacgtcgcaatgactgcaactgaaacgattacttcaaactcacgaattttgggtgttgatccccttgtagccgatggtattggcgaagaggatatcacaaccattacgcttccttatattcactccgcgcgtgaaggtgtcaaacggttaggtgcccttcttgaaaaatatggcacgtacgaaatgaatgccatggctttctccgacaaagatgaagtttggtatttcgaatcaatcgctgggcatcactgggtagcgatccgcatccctgacgatgcctatgtcattgcgccaaaccgtttcaacattgaccaatatgatttcgattctgaagacactttatttgcaagtgatttaccagaactaatcgagaaaaatcatttaaacccagatcctgaccaagttaacttacgtcatatctttgggagtgccacaatcaaggatactcgttacaataatccgcgtgcttggtacggccaaaagtatttcaaccctgaaattgaccaatccccaattgatcaggacttacctttcatctgccgaacttctaaaaagatcagtgtggaagatatgaagtttgttttgagttcacactatcaaaacacaccatatgatccttacggcacgggtactgaagacgaaaagaaacagttccggccaatcggtatcaaccgaaatcaggaattacacatcttacaaattcgttctgacgttcctgcagaaattgctggtgttcattggttagcctttggtcctaatacgtttaatgcaccagttccattctacgcaaacgttaatgacacacctgatgcttaccgtaaaacaaccggtgaatgcgacccaactgccatgtactggctcacaaacgttttggcattgatgggtgataacaacttcggtttgtatgaggatcaggaaaacttgtttgaagaaaacacagttgctgattgtcgtcatcttcaaatggaaactgataaggttgcaacccaacagactgacgtttcaaaatacttggagtccgttaacaaccaaatgtcagatgttgcaatggcctatgccaacaaacttctcggtcaaatgttagctttaggcgaaccacaaatgaaattacaattcactttgaacgattaagtttttaagacttgtaaatttaaaaagctgtgaaaaattcattttttcacggcttttttggataattctaacttttatgtatagttttaaacagcgatggtttaacggaaccacaatctgcattcaaaaaaggtgtatccaataaacgaattaaccttagctaacctcgtttattggatacacctttttagtttaatacaagtttttactgtaatttattcgttagatcagttctgaccaacaaaacatcacacttggccacgcgcacgacataatccgctacagagccaatcattgtccgttgtaaagcgctcattcctgttgcacccatcatgatcaaatcgtcgccaaactttttaggagccacctcagcaatgatcttagctgcattgccagattcaattgaaactgacacatcatcaaaattgtatttttcatggatagtttgttgtaacatttcaacatattctttggttcttcggtaggtgatatctaaataatctgtatttgatcccatgtgcccataaacatctaagaaacggcttgtttggatgatagaaataatatctaaatgtgccgaatttcgtttggcagtaaacacagctttagtcacagcaagttcagcattttttgagccatccaccggaaccagaattctattgtattgcattgggtttacctctcacttcagtcttctaagttgattataatcaatattagcctgtagcgctaccatttgagaaaaatttatccatcccgtaaaaaaagtcccagatgtaaacattcatgcagaccggcagatgtttacatctagaactttctttttaacataataagataaacgcattaaattaatattaactacccattgtgtcagctaactctttaaaccacttggcgctttttttaatttcgcgagcttgcgtatcaaagttcacgtaaaacaggccatagcgtttgttatacccgtttgcccaagaaaattgatcttgcaacgaccaaacaaagtacccttgaacatcaacaccttcatttcttgctttgagcaaggcttctacatgttgatcaataaaatcaattcgtggttcatcatcaatttcttcaccaatacccttgtattcatccttataaccaaggccattttcagtaatatagattgttttacaattcttataagttttgctaacccatttaagcatgtcgtacagacctttaggataaatattccaatcccaatcggttgtaggaatttctggatttttaacatgctgaccgacgcctttaaacttaaacgaactcgtacctttttcgcctgtaccgttaaacgtgttcgtactttcgccattatatgccgcaacaaatgatggttggtaatggttcattccaaagtaatcattacgagttgaagcctttttcaaagtttccatatctcctggttcaatggtgagatgcgcatcgttagcttttaaaacttcgtttactaatttcattgtacccggttcatattcacctttaaaagtcccatcgagtaaaaaggtgttcataaaagcatcttcacattgagcagcatgtgtattttccggtgtgtttggataaggataaacaggctgtagcacatgaattaagccaatcctccctgtataacctttatctttgaataaattaacaacccgcgcatggaccagtagttcattatgttcagcttgaattgcattagatacatcaaaatgatgattaggtggaaaattaccttgaatatactgagaaaatgctaaagaaattaactcattaattgtaaaccaattttcaatctcagagaattccttaaaacagaaatcagcatagtctacaaaatagtcaatattcttccggtttagccaatcaccatcttcaaacaaggtcttcggtgagtcaaaatgatgtaaagaggcatacggtgtcaccccattatcaatacaacatttaaacaatcgatgataataatctactcctgtttgattcggttttccataaccttcaggaaaaatacgagtccatgaaatggataaacgaattgcattgagaccgtacatcttggacaacataatatcttccggatataaatgataaaaatcacttgccggatcaggcgcaaaccgcccctgctgttttaaatagtcatcccacatggttttcccttttccatcaaccttcgtggctccttctacttgataggccgcagtagcacctccccaaacaaaattctttggtaaagacttcacacgtttcaatagtgtcatactaatttcactctcctcattctaggctcgcaactactttggtgcatcaattccgagttgtgtttctattttgtgaatacgttcatattcatcaataaagaatgtcacctcatcttttagcatcatggttgtcattaatgtgtcttgaccatgaaccataataaacgtcacatccatgtcactaccacccgcttctttactaagcagtttagtttgttcattgtgggcatccacaattgattggttagattcttcaaccaaagagcgggcatggtcaaaattacctttacgagcctcctgcaaggcctcaattaaatcagttttagcgtcaccagcataggcaataatagcaaacccagtcattgaagtttcttctttagtagccatattatatatcctccatttatttagaaattactgctaaggcagcacattttcactttcctgaattaacctttgaatgtgaatgataaagtaaaccctttcattttcattcaaagtaatcttcaagtttgactctaactgtccacaaatctttccagaaatttcatatgattttggataaagtcgatgaaaatcttgttcaatattattattcaaaacatgatcatcaagagttttgttctgtactctttcaaccaaatattgtaaatgaatcatcaatcgatcaaaatagttttgattgtttaaattacgttttatcccatattccttgaacaccgcattcacaattctgttcactttcatacttaaggtatcggtcggatctgattcagcatcaacaccttttgcattaataaaatgtaaggcaatattctttatttcagcgtctggaaaatggacatttaaatttttattaatcagcttcaatacgtctttggcaattgcatattcagttggataccgttcatgaatatccggcaccatacttgtttgatattttccgttcattaaatgcttatacatttgaaaaatgtgatcagttaaggtgacatagatataatttaaaactgaataatggtacgtcttcttagccatatcaacagctgtaaatgaagtgacaacaatatcaatcggaacgtccttgagcaatgtggcaaaatgttttttaatacgatcatcttccaaatacaaaaggttgtccgcatccgatgacaaaatttcatccccaggacgtttttgataaccaatacccttgccggatacaatggcttgctttccttttcctagttcaacgagcacactattgttattgtatactgaacgaatcactagtcgcattttcccacctccagtaagaactttttatattatttagtaaagtctgtacctttcaaattatccaaaacaaagtttaaagctttctcaggatctcgagttaaggcaatatattgttgacctttagtagcaactaacttgatgcctaatcgatccgtatcactctttaaatcatcataataagttcgcacttggggtgccaaaacaaccatatcataatttggtaaaatatcatgatgtgaaccataagcaccagcgcttgccacaattggctccttgtactgttttgcagctgaagttaaggcattgcaagctgctcactggtaccaccaccagcacataacacaagaaccttaacctcacgtgcaagtctctgactcagattcgaactcgaatttgtttgttctgttttagatactgttgcagtatcactactgctttcttctacaaccgctgcttctgcattattgtcaactacttgtgtaccattaacactaacggcctcctgtgcgtcaacctgggcttctttagccactaaagtagcatcaaatgcacgacagaatggtaaataaattaatgtatcaagaacaagcaagatgaccatcaaaagcaaggatattggctgaaaattagtatccataaacgccccgattggtccaggtaaagcccacgatagaatatacataaagccattcatatgaagtaaatcaatgaataacttaccaataagaacattgatcattggtgttataacaaacggaataaagaagtaagggttcaaaatgattggggctccaaataacaaaggttcgttaaccgcaaacataactggaattactgacgccttaccaattgctttcatctgttttgagcgcatcagaaaaataaagataaaaggaacaacaaacgttgcaccagttccaccaagttcaccaacgaaatttaaaaagttttctgttaaagcatgaattggaaaatgaccagccttgaacagcgtaagattagcagtagtattgccatacaatgcagcttcaaaggctggtttgacaactgaagggccgtgaatacctaagaaccagaacattggaattaaaaattcaataagggctaatccagcataactgtcagcacctttaaatagtggttggatcaatgttgcaattaaagctgaaaatggaacgtgtaatgttgctcgaacgattacatcaacaattccacaagctaatacagaaaacgcaaatggaaaaatgtcacggaagttttgtgaaattgtgcctggaacttctttgggcattttaatcgtaatatctcgttccacacaaaatctgtaaatatttacagttgcaaatgcagaaacaaaagctgataaaattccttcagtaccaaagtatgtacccagataagcaccactcttagtagttccaatagctaatagcatgaaaccacacattgcagccatcatggtagaagtactattgataaattttccacctttaattttgtgattcatagaaccagtcaacgctttagccgttgtaccagctacataaaaaccaacaaatcccatcgtataattgtaaattttgttgaaccaattaattagatcagttggaacgtttaacccaatcaacgttggaatatttgctaaaagaataaagacacttgaaaaaagaataattggcattgctgctaagaaaccatctttaattgccatcaagtaaatattcttggagatcttttcaaagaacgcttgatgcttttcaagtctactaattatgaaattcataatataacttccttcctatataaataaaatataaaccaatgaaaattattctaattttcattgtatccaaattttttatttctggaatcaaacactttcttccaccaagactcacgacgcaaaataaatgaatcatccactcttgaattataattttctaatattgaatattgaaaattctttttcacatattcaaatccagcttctttaataagctcctgtaggcacttatttccaccgtgaccattactaatgtagcttctccatctatctaaaagcatgccgtttttactagttgcagaaccaacatatagctttccattagatacatcacgaattaaatataccgctttttgatttgaaagagcggtaatccactcacttttatttttttctaataccaactttaactgctgatatgaaaggcatacactatcataacctggaaaaccatcattcttatatacatctggtaaaacttgagaaacaaccaatttttcaagtttactttccgcgttaacaactgaagcttggaaatctttatgatatttaattaaaacccttccatataatggacgataccgtttcaattcctttccagcataatttattccatgaattacacttaactcttccgtaactaatttaactgttgtcagaagataaatatctccctttactctaaccaaattaattgcaacatcattaacattaaaataacgtttctgatttctccaaaataaccattgattattaatcagctcaggattcgcttgaaacacgtctattggatcttcttcggtattccattgattaaacttaatttttacattttctaggttagacaaacctaacaaatcatttaaataaatagcatgtgtactcaacaaaaaaactcctaaccattatgaatttaatgttgacgggttacggttttctgttcagtttagagggagtgacgttttgagcgcagaattgttccctggaaacagttatttggaataactgaaccagagtgcaattctatgctaaggtttccccctagttcgtcggtcgttaacgcccgtcgcttgtctgtacaattgcggtattgctaccaccactcattataaacctacgttttcggtttagcctactaaaaaacgccctagtaggcgttggcaatacgtatttatttttgttcgatcaccaactaatcaatggcaccaagccgaagcttcgttttaccacccgcgccgttaatggttgcgctcaccattcaccacccagccgtacagataaccttgttgtggtatagccagacttattgacgtcgcactggcaaacgtgtccccttagatttatactctagcttgtcccctagaatggtccgcgagaagcaattgaatgtcaagacttgcaatttgagagtctataccgtacaattaatacataaattgggtgttgttcccgcgaaggtagatggtcgcggggcttcttttgtatattcagttattttaggtctggcttaattgctaggccttttttaatacaaggatattgtagctccttattaggcgagtgtcaacttttattttcacagcactatagcactaggttgttccagaactactgcactataaggctactgcactataaggctactgcactatgtagtgctgtagggccttgatatgtcggtgataacatcacgtttttaatatgctgtatagcactacagaactacagaactacagtacaactgcactattgacatacagaactatgtagtgctataattataaacagaaatggaggctagaacaacatgactcaagttattacttttggcaattttaaaggtggggtaggaaaaactagtaattctacaatggttgctttagaacttagcaatcgtgattttaagactttactagtagatttggaccctcaaggtaacgctacaaatttgtacttaaaaacaaaactaaatatcagcaatgaagttgggcatttcgacaggactttaatgtctagtgtagaagatggcaatctagatagctcaatcatcaacatcaaagataatttggacttgctagcatcagcacctgacttctcgttatatccgagatacatggaaaagctccataattataatgatagggtgaaagaatttgataggcttttaacgcctctaaaagctaaatatgactatgtaatcattgacataccgccgacaattagtttaataaccgacagcgcactatatgcttcggactattgtcttattgttatgcagacacatgaacatagttttgaaggtgctgaggcatttatcaaatacattcaagaagaagtcattgacgagtatcaagcaccaagacttgagttagttggaatcctagctgtcttactgcaagcgggagcaccagttgatgaagcaacggtagctaacgcaatctcggaatttggcgaagataacttatttaaaactagaattcactcaatgcagcgtttaaagcggtacgggattacaggaattacatttaaatcaaagtttgataaacgtgtatttgcagtttataaagatgtaactgatgaactactaaaacgaattgaggtaattgaacatggctaactctcttattcggtctaacagaaacaaagcaactgccattcccaagccaactaagcaagctaaagcatcagattttgacaaaagtgctagtgacaatagagcagtcagctcagtaacatttgacaccaatttaaaaattagcaaccacactaggaacaaactccaagcgatggcaatgattggatacgctgaaaatcagcgactatccgttgatactgctattcagtcattctatgaggagctgtctacgaatgaacaacgtgaatttgacttacaggttagcacactagaaacaagagatgtaaaactgaaaagtaggaacagctagcacataatcataatttaggtggaatcgttatactattattgtagagataaacaaggaggaattaaaatgagttattcagaagcaatggctaaacactactatttaaaagagtttgctgataaattggactctaataagcctgctaaaattgctattcagcatgagataaacagcctagaacttaaaaaacaatggttggaagagttcttaaacagcgaggacgataaagaaaagagataattaaaaatgttcggaagtttattacaattattgggactatcaaggtggtatcaccatgaacagcacgcagataggttgaatgctcgtaaagctagtggtaaatcagtctttagttatgatgacctcaaaggattacgcaagttggcattctggctatttgtattcagcatattcctaaattgggggcatgttcggtgctattatgctaattgcatggctagcaatgtgggcaataagtataatcttttagttttgttgtaaattaaaagctatctcaaattactgaggtagcttttttatggttgatataattattgtattgggtctcccggtgcatgaattttacctgtagaactaactccccaagcaagcccgtcatcgtttacaaagctccaagaaccattgtcgccttcacttgcgttcaagtcatctagtgatgtacctccaaaatcatcatccccattgcctcgagatttagcccagtttcttagaatctgcttggcttgggattcagttaaggctgtagaactagttgtagactgagtagaagaagactctgatgaactagagttttcgactgatgagctactttcagaagaatccatgtcatcattagtagaatttgctgttgtgttcttattttgagtaattaatttttgttcagtcaaattatttgaactggcaatgttatgtgtaaatttagtataggccaacttattgtcagagttcaggtactcaatgtagccattacctaaagtaccttgttcgggcatcttttgaaatagctggttgatactctttgtctcaccggccttgattgttagagtgcctgttttatcagatataattttatttgatggcaggacgcaaatgaatttagattggtcaaatttgatgttcttattcgtattattcttaatggtagcagacacaacataaacggggtctgccgtattgtcctcggtgtcatcttgatttaatttaaaagtaaatttaacatttcttttggcactatttgataaattctgaaagtaactggtcttaatagtgcgtgtgctggttttagagctagagctagtttccttttggctgctactattagtagtacatccgctaagtaacaaggttagcatagttgcacttaatattaatgacttttttatttggctctatgatatttggtgttgatggataaaatccatcgacgccttttttgtaaaacaaactaaaaagggcatactgccctgtgctacaatcaagttgacgaaaaccaattgaaagcgagtgaacagtatgtcccaagaccagtctactagacttttacttcaaattaaagataaaaatataactcatttgcgtgttagtgatactaagcgcgatgcgcttagagtttatggaactctttcctacaaactcaatgtttgtccgtattgtgctcaacgacaggtcgtttgtaatggtcataaaatagtatatgttaggctaccaaacgttagcgagcgcaccgttattttgattctccgcaaacaacgttttcgctgcaaggcgtgtggtaaaacaagtatcgcccaaacaccagtcgttagaagacaacatcaaatctctgaaaatacgcgacatgctatcgacaagactttaattgaagatcgaacgatgagaagtattgcagatcagtataatgtttcgactaacttcgttagtcgccgcattttagcgctcggtaagcagaccatgccagcgtatgacggtcttccgcaaaccttatgcattgatgaatttcgatcaacttctaaccaaatgagcttcattacaattgatggacaaaagcatgatattatcaccattttacctggccgacagactaatgaaattaaacaatttttcctaaaccattattcactaaaaaatcgtgaacaggttacccaggttgtaatggatctcaatgcacaataccaaacttttattcattatctatttcctaacgccaagttaatcgtcgacaactttcacttagttcaaatgaccttacgagccttgaaccaaactcgtgtccagttaatgaaaaagtatcacccaaatacccccgaataccgggtgctaaaatcgtattggcgcctgtaccttatgaactatgaagctctcgagaaaagtcaaccacaatggttttcacatttacgaaacagactgactcaagaacaacttatctggtctggtttaaatctcagtcatgagtttgaaaatacttacttcaccgctcataaactcgtcgaagcttttcgtagtcgagactatgcagcttttactgcgacgcttgatgaggttgagaacgttagtcctcaactctttacgaccatcaaaacatttattaaaaataaaaagctcatccaaaatatgaccagtagtacactttccaacggtcccattgaaggcgtcaatcgaaagattaaacagattaagcggacagcatacggataccggaattggaaaaactttgtttttcgtattcaaattgaatttaaaatcagattaaagaaaaggaaccccgttcgcaagtgaacgaagttccacataaaccctccatcaacacccgttgacaaagagccttttgttttccattatatcaaaaggcggtctagtgagaatccgaagattctcactagaccgtcttatttgtggagacttatgtcacagcctctttttgatttattcgtgatcctaaacagcaagttataagtggtcgttacaatttctattttgtaaactcaagttcaccaagagcacgttgggctgctaagttcaataggctccactgtcggtcaaagcctggctggaagaaaaagtcagcttcggctaaatcttccagttttaatccttgttggatggctaatgaaataacattaccttgggcagtgatatcataagttgacaatacagcaccacctaatagttgatgagtgtttggattgtaatccagctctacgtagacctctgtatttcccttctccatagggacataagctggacgtaaagtgtctttgtaaaaagatgtgttaatcttaatatcggccttttgggctgtggtcatattcagacctgatgtggcaaagtgatagtcgaaaacacttaatgctgatgagccgaccactcctgaaaatggcatagacggtgtgttctcaaagatgtgttccactacataacgggcttcacgtcgggcaaccgtggctaaagctatcggcatgttcctctgagcaggaattgaataggccaacaccgcatcacctatggcatagacatcaggcagattagttctcaaatatttgtcagttttaatccacccgcgcttatctagttcaaccgttccctttaaccaatcagtattaggtttaactccaacagcttgaatgatcaagtcactaggatattctgcatcgttggtcttaacagcagaaaccgattcagtcccttcatagcattcaatcttagcgccagtgacaacttgaacgcctttgctagtcaattcttttgataaaatatctgttaattcggtatctaggtagttgcccagaggccgattaatcatgtcgattaatgtaacattctttccagctttgatgctggcttcagcagcttcaacaccaatgtaaccagcaccaataacagtaatatttttaacatctgggtcagataattttgctttgatcttttctgcccaatccttgccgcgcattgaataaacgttttttagctcatgaccaggaacgggtaaatcgtttggagttacgcctgagcttaagattaatttatcgtaatcatagctctgtatcttaccggatcttaaatctttcacggtaacttgcttattttctggatttattttggtcacttcatgattggcatatacttctgtcccaaatttttcgagatctgcaggtttaaaattacggacatcattaatactcgttacactgttttctaaatataattccataccacaggacataaaagaaataaaatctcccgcttcgaatagtttaatatctaggtttgagtatttgtgagtaagttccaaaaccgactgatggccgccgtgcgaggcaccaacaacaataacttttgtcttcgacataaaaaatatagcctcctaatagatgggtgacaaataataaatcgttaatgatggaagatggatcagatgcccaaagttcggcactaatgcactaaatataaacttaaacacaaatccaacaattaaagttccaagcatatatggtaaaaagtagattgctttcaaaaaattcttgaatttaattttgccatttaacccaattgcgattgccaaggctatcgcattaactaaaactgttgcaaatatggcaaatttaaaagtaaaccaataagcattagtaatattactatttccaaacatgtacagataattttttaaacctacaaacttccatgaaccatatcctgtccagttggtaaagctataaaacactccacgaagaaatggaactgtgtggaaaatgaaaaatagaataccgattggcacaaccattaaataatacgtaagtggtatttttttcccttttctcctacttttcattatttcatcactaatcctttacattggcagaattgaacgctttatcagccttttttaaggtctgtgtaatatttttagaatcactcatacccttggtttgatttaaaccagtttgtgtaagtactgaagtcatatcaaaaccatctggataataatgatcaggataatttacaacgtctccgtcagacaagtacgaagaaatccctttgagagatgtcgcattctgggtaacaccctttacagccgaaaatgaaaattgctgcttattatataattgagagcttttcttgctcattaagaatttaacaaattttttatcagcagcttgtgattttgatttcttagaaattgcaaaggctacatcaattccggatgttactttgtttttactactatcgttattaaccggtagtttaaacatatctaattgaacattcttctttaactgttttgcttgtggaataacaaagttaccattaatcatcatggcagctttaccttcggcgagtgcctttgtaccatcgttataggaggtccccatgtaatctttctgagcatacttactaatggttaagtacttttgcattaccgctttatgcgaactcagatatgttgttttattattcaatcgtttatcaatccagttaccactaatcatgtttgaatccaactgattaaacacgcccatggtcgtccagctatcctggaatggtagttcaaacggagtaattccgtgagcctttagaatctttgcatcagcaataagttcattccatgttgttggtgttttcttaatacctgctttagcaaacaaggttttgttatacacaactcctgatgcattagttgcatatggaacggcatctaacttaccgccttttgaaatagaagtaatcattttttgatattcggtcattgtagtttttgtaaacgactcactgcttagatcttctaaaactccagctttttgtacttgttgataattagtatcaccgccaactgccattacgtcaggcactgtattctttgcaagatctgttttcaatactgttccggcattagttggagaagaaagttgtactttaatcttcgggttcttcttctcgaactctgaaataagttgcttataagtgcttgcattttcggtcttagttgaaaagaactgaatcgttgtttttgactgagaagattttccacatcctactaacaataatgacaacgaaagcatgctggttaatccaattagtaattttgtgctttttttcattttattttacttctttccataatttatttagtttcattcctagatataatgcctcaagacaccttaattcactctttttttctttcatagatttcctcccctgaaatcatttactaattaacactatctattgttattcctgtagataacatttgcaagcgctttctaagtgttaccgttaacattattttttatatattttgaataataattggattttgactcacttttacaatccctcgattgacctcaatttctgaactgtcaattagattcgtgtagactccatcgttcaatgacactttagcaattccatctttactttttaatgaaaagattccaattcttattttattatttttagaatacctcacttgaacaatatcattggactgattcataatttcatattttccagttgcttgaatgtcatcttgtttcaaataatgcatttttcccattaaatcggataaatgaacgctcgcagtccattgaagtttgtcttcatcaaacaatgttggtgtatgctttaatccaaattcttgtcccgcgtatatcaacattgcacctttttcaaactccgaaaaggccgtccaattcaccaaatcattctcattttcgataatttcatgggctctttgattatcatgattttctagatttctcaattttacatagttagcaggatacatcacatcttgccgattcaacaccttcacataatcagccagtgaagactttccgtatacatagtcatgccaatcctgatcaatgtcataatcgtatgcgaggtcaaatgcccgataaatctcaccatctgacgaaatccaatatcctttactccgaatctctcggatgtagtcgccacccgtcgattcagcaagccaaaccatatctggtttaacctgtgcaacctctttacgagccgctaaccaaaatggcaacgggacttggggagcaacgtcacaacgaaatccatcaacaactttcgcatactcttttaaagtttcaatttggtaatcccacaacccgtgatttgtatagtccaactctgcaacgtcagaccattctggatttttattaaacagttttccctgtttatcatgcaagaaatattctggatgcgcttttaacaatactgaatctcgcgaagtgtgattatacacaatatcaatcattaacttcattcccaatccatgaatcttatctgccaaatgaacaaaatcggcccaagttccttgggcgggatcaattttgcgataatccttaattgaataaggtgatcctaacttgccttttcggtccactttacctactggatttatgggtagcagccaaataaaatcagtccccagcgccttgattctgggcaaatctggctctaacgccttcaaggttccttccttcgtgtgatttctcacaaacacactataaatttgtaacttccgtaaatccgtacttgtatcatctgccatcttttttatctcccttatttttcttcaatcacaatacttccagctggttccattgtcaccacattatcaacgagtgaactagccttattggataacagcgtatgaacgaccttcaaagttggcacatgatatttgagcaccttgtcagcaaaattcacaatcacaaatgcttttttaccgttcaattcacgttcaaacgcataaattttagaatttgtttcaagtaacagataacttccttgtgaaaacaacggttgtgccttaacttttaaaactgctcgatagaaagcaaacaagccgtcatcattttctacagccgtatctgctgcagcttcattatgatctgcccagttccaaggatgatgatttgaaaagccaacgtacttacctgcattccattgaaacggaccccgtgctgtcatttcatcctgttgattgaggagctcaagaatcttttcatccttatatccttgattttgcataaactgaattaaatctagggcccgttgatcacggaaatcacggagctttttatacttcagattacgcatcccaatttcttcaccgtaatagataatggggattccccgctgcaaatacatacatactgccaaagctttcggcaagtcagaatctttagggtcaatatgcaatcgatctaaaactcggctaatgtcatgatttccccaagttaaagctggtaaactaatattttctaaaacggcttcccaaattgaaaaagtttcttttagtcgtttgagactcaattgtcgcggttggaaaaacataggaattttgggatctttcaatggatattcctcaccatagttgtcagaagtcaccaccatatcacaaccaaaattatcaggacgcgtatactcagcagcttgataggcatctgctgaagaagcttcaccaaggaaaaaaacatcatctttgtacgttttaacaagcttgatgaaattctccaaataaagttttacctctggcaaatttgcgtaaaacgaggagtctaccgggtaatcttcagtttggtttaaaatattttgtcccaaattagctttggcaatgtgaataaacgcatctaatcgaaaaccgtctacccctttatcaatccaaaacttggcaatgtcagccatcgacttgcgaacttctggatttttccaattcagatccggcatctttttatcaaaaatgtggcaataatattcggaaccgccatttggatcaggttcccagacactgccaccaaaaaatgagccccagttattgggccgtttatcttgattttcagcccaaatataatatccgcgaaaaatactatttttgtttttcacagcatcttgaaaccaaggatgttgatctgatgtatcgttaattggtaaatccaatattaaatgcatttttcgtttgtgaatttctttaaccatttcttgaaaatcatccatgtttccaaggagtggatcaatcgcaaaataattagaaacatcgtacccattgtcaatttgtggcgaaacaaaaatcggatttagccaaattgtgtttgcccctagccgttgaacatagtccaatttccccgttattcctggtaaatcaccgacaccatcattattagaatccttgaaactcttaggatatatttgataaattactgatttttgataccactcattcattgcaaccgctcctctttgaaaaccttttcattgaaagcataaaaaataagccatctaattgcaaggcttatcgtgcatgttaccggtaacattatttaacattgttgcgaatggttccacccacactaattttaggctcaaacattaaggaacctgatgtttgaatgtgattcacaattttatctaaaagtttgtcaccacaggccattcccatttctacgatggcttgtttgactgttgtaatttgtggaaacgcaacttggtttaaaaacaccccatcaaaaccagtcaccccataatctttgggaattaatccgccgcaactttcgattccccgttctgctcccaaagcaagccggtctgaagcacaaataaaacaagtattgggttcaaatttatcccagttatcaatcacgaattgttgggaaagatgactgtgattatcgaatcggtgaatttctgaaaccatttgattttcctgtaaaagttgtaaataaccagcctcacgcgaatattcaaacgattctcggctgtccatgccaataaaaatcagtcgtttataacctcgttttaaagccaaatcggcaatcataaacgtaccagctttattgtttgtatccacatagtcaaatccaaatcgattttcgccaaaaataaccaatggctttttcaactcgccgatccaatcaaaatcctttttgcgcattcccgtgatcacgtacccatcacaattaccaatatcaaaatttcgtctagtcactaattgcaacgagtactgttgcgcatcgagcgagcgggcaatgccaatcattaagttcatataataaggttctgttgtgtcaatatcttcaagtacacaaaatttaataattcgggtgctattattcaccagcgcttttgccgcaacatttggatgatagtctacttcgcgcattgcctgataaactaattgctttaaatcatccgtcactttatctggatgattaataactctcgaaactgtcattttcgagacatttgcaagtttagcgacgtcatttaaagttgccatttagcattcccctccactgatttagatagtcaacactttcattataccaagtaagccctttcgaagctcagttatttttctaaaagccctttcatttattttctttcctattaattctatttatcagactcgaaactgtgctacactttttactgaagttacaataatcaatttaaatcaaattttaaaatgaaatataaataggagtgtgcatatttttgaaaaaaatattagttctcaatgccggtagctcttcactaaaatggcagcttttcgggcttgatgatctttctctcattaataagggagttatggaacgaatgaaaacccctgaagcaatcttcactattgttcgaaacggcgaaaagtttaccgaacaaattgctaatttaacttatcaacagggtgtagaattgctttttgatcaattgaagcatctacacttaattcaagatgtggatgaaattgccgctgtcggccatcgcgtagttgctggtgccaccacttttaaacaacctactcaaatcaccgaaaagaatttaagtgagttaaaatccttaaataaatacgcaccactgcataatccggttcaagtggaatgtatcgaaacccttatgaaggttttaccaaaatccactcctgaaattgccgtttttgatagcaaattctacctagatatgcctgagcaaaacgccttatatgccatcccgtatgactattctaaacagtaccaaattcgtaagtacggtgaacatgggattagccatgaatatattttgcacaaaacagcaaactttcttaaaaaagactatcatgacatcaaacttgtcactttacaccttggtggcggtgcatccataactgcaagtgaaaatggtaaaccttatgatacttctatgggctttacacctcttgaaggcctgccaatgggaacccggtctggttccgttgatccggccgttgtcccattcttgatggatgaattacacgttgacgctaacaaaattattgatattctcaacgaaaaatcaggtttacttggcgtttctggcatttcagctgacatgcgtgacattgtgtctaatgcccctacaaaccagcgagctaaattagtgtatgatatgtttatcaactctgttgtgaagtatattggcggctatttcaccgaactaggtggcttggatgtcatcacattcaccgctggtattggtgagcatcaagcctccttacgaacagacatcattgatcgacttgctgtattaggtattaaactcgacgaagatagcaacaataatggaaacggaccacgggtaattagtgccaaagactcgaccgtcaaggttttgatgattcccactaatgaagagttagcaattgacatgcaaaaaaaccggcagcagaattctgcgccagtttgattatgctatttgttaatattttgatcgcgtggtggcaatggcttaaagtcatataagatttttgactgacgttcaaactcatcaatggcgagttggatcaagcgatcgattaattcagaatatgaaatgccagaggcggcgaacagctgcggatacaaactgatgttggtgaatccgggcagcgtattaacctcactcatatatggcttgtcatctttagaaaccagataatcgatccgagccatccccttgagtcccaatgcccgataagtcgtcaagcccatttcggtgatctgttgggcaagttcttccgagatgtccactggaacgtcaaatttaacctgactggcatcaacaaatttattgtcgtaagtataaaaggcgtcgtctttgggtacgcgaatggccccaatcttggatgcgattggatgatcattacccagaatagaaatttccagctcttccggcccctcaatcgcttcttcgatcaggactttgctgtcgtatcggaaagcatcgcgaatcccttcggaatattcctcggcattttcaactttgtgaatcccaacagaagatccctggttagccggcttgatgaacaaagtctgtcccagttcatcactgagagagtcatagctgtactgctcggccgtcagcggggtaatcacttcatagcgggtggttggtactccggccagtttgacaatcttcttggtaatatccttatcaaatgacatggctgaccctaagatcgccgttcccacatatggtttgtgcaggagacgtaatagtccctgaatcgttccgtcttcacccaaattaccgtgaataatcgggaagaaaacgtcaatatcggattcttcagccaggttgattatccgagccaaaggattcttgaggtccaatttagctaattcctgcttggcaacctcgtcttccggttctccgtcgaaaacccgagaggaagcttcatgatccaggaagtagccgttcttagtcatcaaaaacaaactcacatcgtaacgttctttatccattgcgtcataaatgttatgagcagagcgttttgagacatcatgttccgaagagttaccgccaaaaatgaggccaatgtgttgctttttgtgtttttccatgaattctcatccttttataaattcgtatagtttccagaaacttaagtatatcacggaacttcacagttgaaaacatttacaaacgcttctcatcacatttttaggttgaattcaccgatcacaattattcacgttttaattgtttcttactgaacaagtagcgggtgatcaacaacaagatcacagaaacgatcagcatgctcacaatcatcggaaatggatcgtaggcacccgttgcccggtatccgaggacaaatttggcgaaattggcaacccaagtcatctgaaaattgcgatccaaaataacccgagatgcagtgtacatcacggtgatgtagccgatgaccggcgtggcgatcaaaatgatccgctggacaaatttagagaataacgttagaaagttcccgataaccatcccgctcaaagcgccaacgattaacaacaatccgctaaaaataaagttgaacaaaaatgcgacaattgggttattaaagtatccagcgtacgaggacatgtagatgttggtgtctctggcatgccccaatggcatcaagacggcgtactgatacaccaagttaaaggtattgccgatcaggattaacaagccattgacaatgacttgcgcattgaaaaaagtttctcgggaaatcccgttttgaatcaaaaacttgaaattttcataggacagcgttgaaataacaaacatatacaggccaaacgccgctgtcacccaggacccctgcatctgattggttaaggaataatcattcagagatcctgagatggcagaaaacagaaacggtagtaccaaaaaggcggcaaacaagaacagatacatttccgctaagccgataatctgtcgtcgaaacaggaatttggtgactttatttgtcttcattcttggcactcccctcatattgattggttaggaaaataaacagtttctgcaggtcaaagttggacagctggactgtgtcgggcaggatgcggtcgtcaaggtcaccatagacgtagttggcccggatggtgcccatcatgtcgtggccaatgacgtttaagcccttggtatattgctcgacgtctttttctggtcccacgaccgaatgagtcttggccaagacgtcttcaaccggctggtttaaaatcactcgcccctgatccaagacgatcacgtcgctgataatattggcaacctcttcgataaggtgggtggaaacgataaatgtccgcgggttatcggaataagattgaatcaattcactgtaaaagagttcccgatggttggcgtccaaccccagaaccggctcatccagcaagacgtatttgactgggaggcacaaggccaaaatgagtttaaaaatcgagttgtaaccggtggataatttaccaaatttttgattgatatccaagccaaattctttgatcaagtgatccgctaattcatggttgaatccgccatacagagattcggaatccttgagaatttgggtcaatttccagccgtcagcgtaaagattggcctcgctcatcaaatacatcaaacccagctttgagtcgttatcgctgacatcctcagaatcaatcttaacttcgccgctgtcggcaaaaatccggtcggtaataatactgagcagtgtgcttttcccggcaccatttcgcccaagtaagccgtagattttgttgccgtcaaatgacaaattaatgtctgacaagacgtgcttagacccaaatgatttcgagacgtgactgacttccaatacgctcattgctggtaacctcttttcactaaattcaataactcatcttcagaaatatccagattctgggcttcccgaaccagattttcgacaaactcatcaaaaaagccattccgcttttctaccaagattcgctgcctggcgcctgcctggacaaacattcccagcccccgccgtttttcgatcaaatttttagcagcaacgatgttcatcccttttaaaacagtcgccgggttgatatgaaactccttggaaatttctgttgtcgacggaatctggtcgccttcagcaaagcctcccgaagcaatcgcgtcctcaatttgttcggcaacctggcggtagatgggctctgaactattaaactcaaacttcatatttatcaacccattctataatttctttcatttaacgctccaccttcgtctttggaaccacaattcgggaataaatcaggacggtcacggcaaagtaaatcaagtaaagaaccaagaagccgactgtcgtcagtccaaaggtttggtaggcgccacccatcaatagaccactcttggcgaacatttgaaggccaaaggcaacgtcgacaattcccaaaattccgggcagtgcaaacaagcccaggatttgaacaacgattgagtggtttaagactgatcgacgagtcccaatcttattgagcatatcaaagcggatcttgtcactggctgccccactcaaaatcttaaacattaagcagctggcaagcatggccagaaaggcaattcctaagaagattcccataaactcaagactgccaaagacactcttcagggattgatacatcgtaaacgaaccgccgacctgttccccgtttcgatagccgtactgcttggactgaatgttggtaattttggtcagtggcgttgcggcagcgtccatatcatttgcgcgaaccaacaataattgattggtcttggcattaatttgattgaatgtctgagaactgaccactttgatttggtaggctttaaccgttggtacctgtagtccccacagctcttggtatgccgatgaatcgcttcgcttgaactgggaaactttggcggtgaaagcttttgacgccagtgtctttcgactcacaaacgccgcgtacttcaatggttggcgctgaagctggtcactccggtaataaacccgcttggtcgtcggatcaactttttgttggtaagtgacagtggatttatcttgaatctggccaaccagtgaacgcatttcctgattggggttggtaatagcaactgaatagtagccatttccagaagctaatttaggtaccatgtgttgaaaaccggttcccacagtaattgcgcctagtgccaatgcaaacagcagtgagacaactgaaaggattttggtataatcacgaattctaaatttaagctgggccaatgtgaaactgttcaggcccttggtgctcatattagaacgttgaaatgcctggagcagcatcacaaaaaatgagttgaagacaaagtaggtccctagaacaatcgtgatgagcgcgattggaatagacatgactttcagtttttgaatgtcatacatcgcataatatccaccggccaagagaacaactccaagaattgcttgaacgccaagtgtcaaggccttaggctgctgccaatcactttgttgtccggaacgcaaaagctgcagggcggaggtcttggtgaatgtcctggcatttaagaaaccagcaaccagaaacaaaatcgcaaacaggataatcgttgcaatgatagctggcatataaaatgccgagaaattagtcaatgacatgtgaatgaggctggccagaaaatggctgagcacttgggtaaagccaatgccaatgacaatcccgacaactgtggaaattaaaccgatcgcaatggtctcaaggatgatcaatttactgatgactcctgatttggcacccagcatcatgaagagtccataatcatgttcacgcatactcatcaagaaattattcgcgtaaaaaacatataccagtgtgatgattgccagtaagatggatccgaagatgaaaacgatcttggcattttgtcccaccgcactgctggtggtaaatttatcgtttgttgaaattgcttcaaacatgtagaaaatagctgtggtaatgatcatcccggaaaacagaaccagataatctttccaacgagccttgattcctgagattgaaattttaaataacatcgctaagctcctttgattgattactgttcaaatgtaccgagtttttcgaggatttcctgatagaattcatttctcggcttatcgccggcgtctacctcatcgccaatttttccgtctttgataaataaaattcgtttacagaaactagcggagaacgggtcatgggtcactaagagaattgagaccccctgttgattgatgttcgttaaggtgtccagtaattcacgggcgttggttgagtcaagcgctccggttggttcatccccaaaaataattgacggatttgacactaaggctctggcagcggcgacccgttgcttttgcccaccggataattgcgttgggtacttactcagcaagtcatcaattcccaacttgctggcggcttccttgacagcagtttggatcttagccgccttggcattttgaagcgacaacggcaaagcaatattttcttgggcggttaaggtttccaataagttaaagtcttggaagatgaagcccaatttttgagaacgaaaatctgccatctggttggcagttaaatgagttacgtcttggccgtcaatttcgaccgaaccgctggttggttgatcgagagttgccaaaatatttagcaaagtcgtctttccggaaccggaggcgcccatgattccgacaaattcgccctcgttaaccgacaagctgatccctttcagagcttcatatggttttgcgctgtctttatcgtaggttttgtgtaaatcttctgtttgaacgattttagttgtcataagtgttcctccgtgtgttagttaattacttatgtaactaactatatatgctaagaatccggatgtcaaccaaaaacaaaaaagcgtgggccaataagtggttagcttccagagtataaggggattacccgaatatccggaatttggatgtttgggtaatccccttatacggccggaagctgcttattggcccacagttctgctagataacattcagcctcttaatcgtctaaaagcgttaattaatctagattatcagtattaatgacattctgggtccctcgttcagtgatgatggagaccaagacgttattgatcattttcatccgctgttcatctgtaatcgatgatcccaaatccttttgcagctgggaaacggcatcctcggaaatcgccacggctccttgaacaataatttttcgcgccgacaaaatggcggttgcttgttgtcgctgcagcatggcgttagcaatttcagttgcatatgccaaatgcgtcaaccgggtctcaataatttgcaatccggcgacgtccaaacggtcctgtaattctttttgtaacgcgaccgacacttcggttgcattcccccgcaaggtcaatttgtctgtactatcatcaaaactgtcatacggatactggctggcaatatgtcgaatagcggactcactttgaatctcaacgaattgttcataatcttccacgctaaaaatttctttggcagaatcaacgactttgtagacaatgacagcggcaatttcaactgggttcccttttgaatcgttcactttgataattgaactattaaaattgcgaacccgcagtgaaatcgtctgcttgctggtcaatggcacggtcatgaataatccggaagtccgaattgtcccaatgtagcgaccaaagaaggtcaacactttggcttcgttaggttggataatcgttaatgaacttgcaaataacagatccaaaacaatgatgattgtcccaaaaacgattgagccaattgagctgccttccccgccaatccagagcagataaccgccaactcccagcaaaatcaaggcaataattaagcccacataaccattaacatgaaatacatttttctctttcaaaaaagccgccccctataaactcggattagtaaacaataaaaagtgcacattaacatataaaattgaaaaataacatataacactatgtaaaagcgctttcgcaagtaatattctaagcaatagattcaattgattggtatttaagaatataaatgaaaaatttcccacgatgctaatcaattatcatttaattcaaaaattctcttaaaagaaggctatattcatgaacacatttttgattatcgatattggtacttctagtatgcgtggaatcctttttgataaaaaaggtaagcgcttattcaaggatcaactctcatatcaacctgagtatcacaaagatggaggtgttctccaagacgcacatgttttttacaatcattgtttaaatattaataaaaaatgtgcagactttgctaataaaaacggatataaaattatagcaatctcaatgacggcacaacgttcctcacttatcccaacaaagagtggagagccaacagataaagcgattatgtggcaagacacacgtgttaataaactagtgaaggtatattctgcttacaatgatttttttatcaaaaaatcgggtagtagattaaatgcagtgtatcttggtgcaaagattagttggttaaaacataataagcctgatatttataataagtctgacaaaatgtttaatattccatcgtatttgatttaccacatgacaggaagagcttcaactgataccacgtatggtagccgaacaaatataatgaatattaagacactggaatgggatgatgatttattaaagattcttgatatttcccgtgataagttaccatcaattgttaagcccggagaagtttgtggaaaaatcacaaaagaatatgcaaatttaagcggtcttccagagggaacccctttgatttcagctggtggcgatcaacagtgtgcagcaatgggtgaagggcttttgaataatgactcagtatcaattaatactggtactggaggatatattattaaaaacattgataaattacccgaagtactgacaaataatttaatttataattgttcttccgttcccaataaatatattctagagattgatttacttgcatgttcttcaatattaaattggtttattgaaaatttttatggagatcttaatagtaacttcgacaaagtaaacaatgacctaaaaagttgttatgaccaaaacatcaacgttacatcactcccatatccaaagggtaagtcagtaaatataaatgatactcgaattagaggtgcatttactaatatcgggctttcaacaactaaacaggatatgctttatggtttaatgactagtttatttgttgaaattaatgacgggattgatatcttacgagcttatggtccaatttcttcagtcataattggtggtggattaaccaatagtaagattatgaatcagatgcaggcagatgcttacaatctgaaaattcataaatctcctgtgacagagtctactgcaattggagcattgatatctgttttagtaaatcaaggagtttattcgagttgtgaagaagcatacagtcaagtagttcatggtaaatcagactgctatgttcctaatattcataatgtcgaactatttaaggaactgaatagtcgtaaacaggagctttattatgttctaaaggatactcaagctggatattataaagtagataataagcaaaattactattaatagtgaaaaaggtgacggagtaaaagattaccataaaattaccgtttaatttttaaattaccttataacatgattgaaaataatcataaaagattcataattagtctgtgttaaaaaatatagggaggcttttcacaatggcatcaccaaaaaatattaaagacgttactccagaggtttgggcaaaaaatgtttttcctgagtggggcacatatttaaatgaaaatattgcagataaaaaaattccagaaggtagtttctcaatttggtggctaggttgcatgggcttttggcttaagacccatgagggaaccaacattgttgttgatatgtggaacggtactggtaagcatacccatggtgatggaaagatgagaatgggtcatcaaatgatgagaatggctggggttcgagaacaacagccaaatcttcgtaacagaccatacgttattgatccatttgcagtaaaagatgttgatgcattattggttacccacactcaccatgatcatttagacatctacacagcagctgccgttaatgaaaattgccctaaggctaagtttatcggtcctcaaggtgtcgttgatgaatggattgaatggggcattccgaaggagaaaacaattgttgtgaaacctaacgataaagttgaagttgggtcaacaaagattacagcccttgaatcttttgatcgtacggagttagttacggaagacgatcctaatgttaaattagctggaacaatgccgcaagatatgtccaagattgctgttaactatctaattgaaacttccggcggaaatctttatgacgcagctgattcacacatgtctaacacatttactaaacatggtaatgaacataagattgacgttgcattatgtgcctatggtgataatccgagaggtattacagataaattagacgactcacaggttctaagaatggccgaagatcttaatactaaggttgttattccaatgcattgggatatttgggataatttctatgctgatcctaaggatataattcgcctttgggagcttaaaaagaatcgactgcaatataaattcaaaccctatattcttcaagtaggtggacattttgatttccctgaagacaaggataaatttgagtatatgtatgaccgtggattccatgatgcatttaaccataagcctgatttgccgttccctgaattactttaattgattatttaaattagaattttggaggagaaaactatggcaaaaccaatgttacaagttgcgttagatacaaaagatttgccaacggccattggagttgcacggcaggttgttgacgttgttgacgttgttgaagcagggactttgctgatttacgaagaaggtctaagcgcagttagaaacttacgggcacttgcacctgacaaaattattttagcagatacaaaaacagctgatgcaggtgctgatgttggtgctgagtgtaaagctgcgggtgcaaattggatgacctgcattaatgctgcaactgtccctacaatgaaatcagcacaaagtaaaattgaagttcaagttgaactttataaaaattggacagaggaactagcacaagagtggcttgatgctggcatccagcaagtggtttatcatcaaagtcgcgatgctaagttggctggtcaaacttggggtaaaaaagatttagacgaagtaaaaaaattaatcagtatgggatttaaagtttcggttactggtggtgtcaatcctggggttcttaagttatttgaaggtgtaaatgtgtatacatttattgctgggagagctattcatggtgctgaagatcctcatacagccgcgcttgaatttaaaaaagaaatagatagaatttggggttgacttttgaatgaagttgtaagcatttattagttgattactgggtaaagagctgtttattagcagttctttattttttaaaggctatgaaagcgctataaaaaattcaattaactgaggtaatgatcgatgattaaaaattacttttttgatttcgataaaacattagcggatagtggtggtgtttctatctctgcgacaaaggaagcatttaaagttatggggtttgctgttccggaaaccaatgtaattttaggatatatgggtattcctgcagaaatttcgtttaaaaaaatggcaagggagagtttatcagaaacacaaattcaaaaattaactgacacatttcgaacaatttatcaaaaagttgaaatgaaatcaacaaaactttacccaaatattgtatcaatgttaaccagtttgaaaaaggcaaataaaaatatatttattgtatcaagcaaaaaaacggatgctgtagagagaaatctaaataacctgaagattatcagtttttttcaagatattgttggatttgataaagttaaaaactataaaccggctccggatggaatattattactccttagcaaatatgatcttgttaaagatgagagtttgatgattggtgacgcgaagtacgatattcaaatgggcaaggcagttgggattaaaacatgtggtgctctatggggcgcgtttgatgttaacgggttagctaatgagcgtccaacgtatcttattgatcaaccaatggaacttgtaacgcttgaatagcttaatgatagtagattttgattattattaatttgggaggttaaagtcatgctgcaatcttttatgaacatatttacctcgttgggtgatacggttgttgtacctataattatttttattgttgccttatgcttacgagtaaaggcaaaaacagctatgatgagttcactactagttggtgttggattaactggttttggctggattattagttcatttacacctgttgttacaaaaattattaatcagatgattaaaacaacaggtatcaatcttccagtggttgatactggatggcaaactagcgcattagcgtcatttcattccacagttggaatttccttttttattgttgggttaattctcgaaatcattttattcttaatcggatacacaaaggtgttttttcccactaatctttggcaaaattggggatttatgatttggggaactgttgcatatacagttacccataacttttggttgtcattagggttaagcatttttatgatgctgtacattctaatggttgctgaaatccaagccgatcggtggtctgattactataaaattagtaatggtacaacttcagcattgcataatatggaaaatgctgtaccagcaataattttagatcctctttggaatttatttggtttcaacaaaatccaccttactcctgaagttctgaagaaacgacttggtgtatttggagagccaacatttattggcgctattcttggaattatcattgggttacttggtaatatttcacgtcttagtagtttagatgcatggggacaaattctaacatttggcgtacaacttgctggagttatgacgatttttccacttgttgctcatttgtttggtagtgctttcaaacccttaactgatgaaattaccgaacattatatcaggaagaatactggcaagaccacagaaagcgacgctataaagagcaagaagcgctggttcttagcagttgatgatggtgttggctatggagaatcagcaacaattatttcaggagtaattcttattcctattattgttattctggcgtttattcttccaggaaataagacaattccagttgttgaccttgtatctattccatttatgattgagtcaatggttgcagtctatcgtggaaatattttgaaaattttatgcacagctactatttggctcggaatcggtctttacgcaagtagctatatggcgccgatgtattcagcatcagtttcgcagtacggtgttgcggcaacaaccggtgctgcactaattgttagttttaatgtaatggctcgtcctttaaatgccttaatatttgctgcgtgggtttctggaaatccactatggatcggattaacaattgtcatttacggtttcttccaaattttgcttcgaacgcgtcgtccacaaatttgggcatatcttaagaaaatgtccgacaaaaacaaaccagattatgttaatgttgtgaaaaaagagcaaacttcaaatagaacaatttaaaacagttgattaataaaaattaaattgtttttattatgtatttcttcaatacttcttaatgatgactaaaaaattgtagatgcaggcaaaagcgaacaaatcgttattgcctgcatctctcgtgttcattatacgatttgttaaatttaaatcacgtaaacaagtctttttcatttatttctgctcttatactgatactgggcatcaaaaccaatgtattttgtaacactaagataaaaaaatcagagtacaacactgtgctgtttgaaaataatataattaaagtggtgattttagcttttgacagattagagtagctaaatgtaaatttaactctagtaatttaaattaatatttcggtaaagaaggatgcacttttatcatgaaaaattcaattcaaaatatagaaaaacgtcgtgtgtatttgttaaaaatcattaaatacaaggtctcaacaactgttcatgagttatcaaaaacaattggagtttctgaaatgtcaattcgtcgggattgccgagttcttcaaaaaatgggtaaaataaaagtttcctttggaaaagtagaatatcatgataaaaatgttgaccaagcagagcgaacacaaattgacaaaatcaacgataagattgcacaagcagcagcaaactatattaatgataatcaaatgatttttattaattctagcagaacagcgatcaaaatactggatcatatcaaagataaaagaattaacatattaactaataatttacgtgcgattgataaaaaaataaataatgaatccaatttagtgttgagtgggggagaaattcgaaaggaatcccgaatccttactggtgacattgctttagagtcttttaggaatgtccatgcctctattagctttattggatgtgcaggattagatattaaacatggattaactacaacaaacattcatgaggcacaaattaataaggtgattgttaagaactgtcagcgccttattgtattagcaaactatactaaaatcaataaggtcactaattttaatgttgggaatttgaaagatattgatgttttggttactgatatttattcgaacgataattatattaaacgaattaggaatatgggaattgaagttattcaggttcctatctaaaaattaactatatcatcggcgactttggaaaaattgtgagcgtcaattaaccaccagtctgcaaatggtcgttttagcgtttttagcactattacttaagagattttagacagcttctaagaatcagcaaaacatcttttgtagataccctttttttagttcctggagtttttcaagcttacgttgttgacgagcaatagtattgtctatttgtttgaagaaggtgctgattaacttaatctcgtcatgatttttcggtaaatacatctggaatttttttactttatctgcgtttagattagactgtgtaccagttgaaataagtttattccactctgataattcattcgctttatttaaacgttgataaacaagatctctaaggtcataatcatcaaatatcatgttgtagaatgcttgagatgtggctgcgtcaatgttcaatatggctaatttaccaacactagcatacatagctaaacttattgctccttttgacacaatccacgcagctgaactatttaatccgtctgatgatatatgtttttccgtgttatttataaatccatttgatttagtaatatccgatatacctagaaaaggtatgtctccatcataaaaagctttatttgttgatttaggtgttccacctgagccaccttttataaacaaatcacttaacttacgctgttcccaagcgtcagcaaaccctgcaaatcttaattgcgggaacttgctgccatttttggggaacaatttctgtaaatagccctgtttaagttccttaagcttagctaacttacgctgatgaagagtgatgagatgatcaagttgtttaaagaacgacccgattttgatttgctcatctttttcgactggtatcataatatcctttgtcagcaaatcagccttagtcattcctttaattgatgtaccttgaatattgttcaattctttttgaagtagcttataaattgaatacaatccaaattgctcgtcaacatgtaactcactcaatgatagaaaatcttgtgatgtcgcaaattcttgtttcataagggttagcttacctacaccaactcgagtaactattgcaattgaattagcaggaataagttttgcggcagaatttttgatggcatcatctgtaataaatttatccaaatttacctcttgaacatcatcaactgtgagatttgaactttgaatccacggaatatttccgtcccagtattctgtaactgccgttttcggtgtcccaccaccataagttgttttcgaaaaatcagacaacttacgttgttcccaaagatcagtgaaacctttaaatcttaattgcggatatttagcttggttatctttcattgtgggcctccggttttgactggtcattcacctgggtggccactaactggctagctaattcattaaaggcttgttcattctgactgatttcctcgtccagttgcttcagatcagctttaacttggtccagatcaatctcgggttccggttcaaacgtatcaacgtagcgcggaatatttaaattataatcattctccttgatttccgccggtaaggccacatgagcatatttatcgacatcttgccggttttgataagtggtcacaattttttgaatattggctgccgttagcttattttgattcttgtccttttcaaattcccgtgacgcatcaataaacaagacgttatcagtggttttatgtttctttaaaatcatgatcaacgttggaatactggtggaatgaaaaatattagcgggtagcccaataatggcatcaatccggttatccagcagaagcttttggcgaattttgccttccttagccccccgaaatagcacgccatggggtaagacgatgcccatagttccatgctcctgcagatgataaaagccgtgtagcagaaaggcaaagtcggctttagatttaggcggtaagacgccatagtcgcggaagcggggatcagacaagcgtttgtcactgttatcccagtgcgccgagtagggcgggttcatgacgaccgcatcaaataagtaaggttcgtcaaccggccaatctttacttaacgtgtcaccattgcgtaaatgcatatcgtcatacgagactccatgtaacattaggttcatacgggccaggttataggtcgtggtgttcaattcttggccgtgataactcactaaattggggtcttgcacgtgctgtccgacatttaacagcagcgaaccagaaccaactgctggatcatagacagtccgcaattggttgtcacctgcattgcgctgataagtcacaatctgggcaataatgtcggacacctgccgcggagtataaaattcacccgcttttttaccggaatcactggcaaattgcgcgattaagtattcataggcgtcacctaggacgtcgccttgatgatggataagatcaatcgcatttaaagctaacatagtatcactaatagtttggttccgttgttgtaaagaactgcctaatttattactacttaaatccacatcggcaaacaagcccgaaaagtcttgcgctgaagatagattttgtgtcgacagttccagatcatgaagtgcttgagataaatcgtctaacgcaaaagtatgggcttgaatcttgccaatcagggtggcgtacaacgcctggggttgaattaaatagccgagcgtgttttgcaaatactcaactaaactgggctgcactgagacgccttccaactcaaactgcggatccatatactgagcatatttctgagtgacattttcggtttcgcctgcccaatcactaaaggtcgttaaggttttctcagatagaaaccgataaaaaattaaccccaataaataatttttatattcagaagcgtccattttcccgcgtaagacatcggccgcattccatagggcgctttcaagttgactagcttgcattgttttttctgacattgtttaacctcacttatttttgtagataaattgctaaatcgtgttcaataaactgtcgccaagcggcctgggacttaatccggtatagtggcaaaatagctggaatcttcggcccagtggcagtttgagcttgtaaggccgctgctaaattcgctgactgcgttaattcttgttcatgatgccattcatcagtacccacggtgtgttcacgtgccacccgtaatagggctgcttgatctaagccccacgtatgggcaaaggtcgtcgtttttttgaccaattgtttctgggcgtaatcagccaccaactcccgagcattcaacgctactggcgcttgattttggtcactctgttgctgagactgttgcatttgttgctcaatataaggcatggcttcgcgaattaactgggcctgttgcggttgcgtttccgctaatttattcaaactagcctgtactttggcactgttttgcaggtaatcggtcatatgggcttgggcttgatcaggtgtcgagtactgttgctgttcatcaatccaatcttgaattaattgcgtcaaataatcataatccaccaagacgactgaaccaacggccaaggaaaagtctaaggcagccaactcttcggggactttctcaggctcttggttagtaaccgccgctttaatccgcagatatttacccgtataggattctacttcgggctgagcgataccaaaggccttttcactgttttcccaagtgaaatcgttgtacatggataaggaattcaattgctgattcacttggcgaaaggctttcacaaactgtaccttagcagtggttcctttcaggtcatcggccgccgtcggcgtcggggcaatggtttttaaatcgaccacggccttttgaaattttaagacagcctgatgataagtgggacgaatgatgacattaaacgagccttcgccactatataacttgtaagcttcacgttcattcgcttccatgattgccggtacccgaaaggtcacaatttggccttcttgttttaattcccggttttggagccggttggtgcgtgagtaggcttgaataagttcttgataggctaaggtgcggtcaacaaagagcgtgtttagccgaggggcatcaaaacccgttaataaccgccgcaccacaatcactagattaatttcctgatccggtttcaaatgagcaaagacagcctcacgccgggcggcccgtttcgcgacatcttcgttgtagagattcaaatcggctaaatcaaaattagtgtgatactgccgattataatcttttaaaatggtggccatttggtcatgtttttgcgcactctgatcttcgttttcacttaatgaataagtaatcgcaattcggggccaatcaggatctagctgattgtgagtagtctttttcgcggctttaaaggcttgataatagcgttgtgccatttcaatggagctggtggttaaaatcgcattgtagttgccatgccccaagctggttttacgtgggcctttttgtaaaatatattgaacaacttgttggatatgttcatcagtctcaaagtcagccggagttaaatacgtttcttccaagtccttgactgacatcgcttgaatcttggcttgaattttcgcttcatcagccgtactcagcaggcggccttgcttatcgcgacgtgctttgacgcgctggttttctttctcgagggcccgggttattaacgtatctttgccaattgttgttacatgttccacattaaacggtaacacggcttggtcctctaaggcatctcgcaagttataaacgtgacagactttaccaaatagctcctccgtcgtaactgctagatcacctttgagctgtttcttattttcattaaaaatgggggtgccagtgtaaccataccagttactattgataaacgctgctcgaatttccttttgcatcttaccaaattgcgaccggtgggcttcatcaacaaagaagatcacccgttgctttaaagttttactaaagcgggattgcttaccggttgccagctgggcttgcgtttttttgaccgcccgatgaagtttttgaatcgaggtgaccaagaccttaccgtcattttgttgcaatttacgcattaaatcaccggtattttgggcttcgttaatggcaatatcgtcattggcagcataggcactaaagttgctggttgtctgttcgtctaaatcccgccggtcaactaagaagatgaccttatcgacaccgggatcttgcgcagctaatttagcggttttatatgaggtgagtgtcttaccagaacccgtggtatgccaaacaaagccatcttgatggtcatgaattcgatgcatgacagcctcaatcgcataaatctgataaggccgtaagagaattaagctctgacgttcttggtcgatgaccgtatattcactgaccattttgtgggccatgggaatattaaggacttggcgcgtaaacgctaagccgttttccacggggtgattatcccgcgttcgccaattgaacaaaaaggctttattgaaatgatccggttcggcattcgcaaaatacgccgtactatccggcgtcataatcacaaacatttgcaacagcgagtaaattcccgtatatttaccttcctgcgcgtatttttcaatttgattaaaagcctggttaagttcgaccgtggctttttttagttccaattgaattaagggtaacccattaattaataaggttacgtcaaaacggcgatcagggtcgacgtcttgagtaccagctaaccgtggtcgcactgcttgccgtaccacttcataactagatttaccgccagcaacgtccgctttccaaaataactcgagcgtcaccgtgcccagcttagcatcatcacgttcaacttcaactttgccaatgccattttcggcggctagtaacttagctacttcgtaaggtgtccggacctcaatcgcccgtttaacctgattaaattcggtatcagttaaagggtgtccctgcaatttagcatagttattgttatttaatttatcgcgaaaattagcccataattgatccggcgtcgcaccatacaggtcttttcgttccacccattgattacttccggtcgttagggttttaacaacttctttttcaaatgacagttccaacataaaacattccttcccccacctttaaatgactcactagtttattatacgcgaacagattagcgtttaggcttcataatttaatatagctaggatacaaataaagccaaatagacaagcatcaaaaaaacggaaggttaattattaagtaaccgttccgtccttttatgttgaaacatttcgaatttctggtagtgggataaaccgatcagcatcaaccacaatatcattggcattgtaaccatgaatcaaggtggtgatatctggccaatgacggttgttttggtcaaccgtttttaattgaatggtcactggttgttgacgctgatatgcgtctgccagtagttgggttatctctgctaaggattgttgcggtcgcggaacatagacttcattcaattgctgcttctgttggtttaaagcagcagtatggtcggataaatagaagccctgccatttcatcatgccccggtcatgataatcatgttcaaaaaaacgcttagccgtgtctaagtcaaattcttggttattcaagtggcacccgctttcgttgaatcagcttttgactggccggccaccgttccccagtaaagccgacaaattcgatcgttagctttatatcttgtcgtaatgcttttagtaaattttctaaatcagctaaatcatagttagctaatttatgtaagggaacggattgcaagcgctcgttagcccgttgactgttaaaaaacagattataggtctgatcgtaggtatcattagtcaacattaaccaatagcgggttttgggacgccgcttaaacaatagggttaaccgccccttaataatctcgatatcgctattcatagctattactcggccgcaagaactcgcactacgttccagcctaaatttgctggaagacggcattttatctaattttgctgccatgaacgttttcgtatcaagcaacaagataagtttttgtagtttcaacctttagtaccctattatttaattattcaacccgtggttctcttgcttcatctgctttacgacgccctttatccatggcattcttggcttgatccgttttcttagaagcaaagttacctgtcttttcggcagtgtttttcaccttatcttgtacagtctcactatccgcttcatactcttcacgagttttaacatctaccacgttcacattaacttcaatgacatctagatgagtcatatctttaacttcacgtgtaataacttctttcatctgttcaaaaatatcttcaatatctttaccatattcggcaacgatgtccatatcaatcgcaacttgttttttgccaacttcagcattgatccctgaacgcacatcatcactattgaccaatttatctttaatattagagaaaaatccaccatcaacagtcagcaaaccgtcaatctcctctaaagcaattccaacgattttttgaacaactttatcatcgtaagtaagttcgccattaatatccggttttgtttgtgcattagatctcttattcatttgatcccttcctgtcataccgtttggttgaattaattctttttctttcatgttagtttcctcctatttattctttgttattcaaatattcatctaacagatggcttttatctaaatacagcccaattgctgtacctacgcccaccataatgatgagcaaaagggtttgaaaaaagccaatcgtaactaataaaactgcaataatcagtccgaccactcccccaataatagggagtttatattcatcaaatattgctttcatttgcgacctcctactctacgcgaacgttttttgaagtagccgctccccttgattggtagcgttctagtctgacattaaccttaactgaatgatgagcacccacaagattttttattcggtcctggactctgtttgaccattcttcagtatgatcaactagagcagaagttctcttgatttcacctttaacaattactgtaattcgtcgatttaacgtttgaaccttcactttaggtgatccaataaagtcctctttattgagcattgaacgtaccattccttcaatggcccggctgtgcacactcaacttgcctcgattttcctttaaagtaaaagttgtcgttgctttgggataaaaaagaatgatcaggataacaatcaaaaaagcagctaagacaactacagaaatccaaaacattgtggtataagcatagtaatttgttaaaaagaaatctctcatattcactaaaaattgggaatgctgttcccccggccaagttaaggatgtgacaaacaagcacaataccataaagagtaaggcacaaacaatgaggactgttttaaaaaatttattcatatagttgccctcctataaattgatcgcctctccacccgttaccccataaatttgggctgtgacataacttgcatcattagaagctaagaaaacatacacgggagctaattcggctggttgtcctgctcgctttaacaaactatcctgaccaaattttggcaaggcctcttttggctgacccttatctagctgaataggtgtccaaatcggaccaggagcaacaccatttacacgtattcccttaatggcagcttgtttagctaaattaatagtaaagtttgcaattgctgccttcgttgctgcataatccattaaatgtttactaggattaaaagcttgaatagaggtggttgtaacgatactacttcctgccggtaaatgaggtaacgcagcttgcgccaaggcaaacattgaaagaatattaacttggaaagtgtcgtttacttgtttcatagacagatcctctaaatttgaacaagaaacttgctgacctgcattcaaaactagcgtatctaacccaccaaattcatctacagtatcttgaacaagttttgctgctgtactttcttcacgtaaatcggctggcagtaataaaatacggcgaccagcctcctttacgtactctgcaacagcatttgcatccttttcttcacctggaaaaaattgaagtgcaatatctgcgccttctcgagcgaacgcaatggctgttgcccgaccaattcccgaatcaccaccagtaattaatacacggcgattctccagtttgtgattgccacgataacttgtctcgccgcagtcaggtactggttgcatcttggcctgaagtgccggcgtttcttgatcttgcttttcaaagccgtcagtatgatacaagtaacgtggatctttcagatctggttccttcatagcttactttcccccttcttaactgtcatattgggtctaattagtaaacccattatcaatattagaaaccccattttaaagtgatcaccctcatcttattgttaaaataaaatttccttttgatacttttaggatatcgaaaccagattagttttccaagcaagatgctcaactatttctaatgattaaaataagcatatccttttaactcgttatctgatttctgacataatagaaataaacgcaattaaatgtttgatttcatcatgtaaaactgaacttgaaaggagagatatagaagtgattttaaatttcaacatttcaaaaaaaggtatcactaaagccaaccatccaaaacaaatcaattggatagttttaaaaaatgccaccaaagaagaaactcaaaaaactatcgatcaatttgatcttccaaatgacatttttatcggatccagtcaagccgaagaagtctctcgatttgaaaaacttaaagatacaaacttgaataatagctattctcttgtccttattaatctctctgccaatactaaagaaaatattgaattccgattagagcctatctcatttgtaatatcagattcgttacttatcacttatgtctgtgagaattcagagtttactgaacatctcgttgaacaaaggggacaggaaatcacaaacttagatttgctaatttcatttgccattttcaccacgtatacccattttattaaggaactacaggaaataaaaaagacaattgatgatttagatcaggccgcaagaaaaactacagaaaattcagaattattccgtttagctgacacggaaagaaagattgtctatctagatcacacattacaggatcaggccgaaaccttagattcgttatgggaagaaaaggcgttcatttcaaatattaatgatgaagcattgatttatgacatcaagctcagtcaacgccatgcaaataaactagttcgcgtttatcgagacttactggaaactattggtggactgtttactgacatgatggataataatctcaatcatttaatgaaatttctagattcggcgggattagtcatttcgattcctgctttaatttctggaatttggggaatgaatacaggtggaattcctggtaaaagttcgtcgtttggttttctcattgttatgagtttagcaacccttcttacaataattacagcaattcatttaaagaaaaaagattattcaaaatagaaaatgcacaaacaatctaatacgctgtatgttcaaagcacaaattactcatgtgatcaaaaaaagatccaaaagatttgccaattttaatgtgttttagctatttaagtttgcaaataaaacaggccagagaaaaaatttctctggcctgtttttaaagatcaaacattttcaatattaattatttttcataattacctgtaattgtattcagtttagaataactacctgtttgcgtattataacggtaaataccggtcaaactgcctactgtattggaagaattgttctgacgtacttcaacttggtagtagttcgtaccaatctgcgtcacaccaaaagaaagtccgcgctgattagtaatccccactgttcccgtgaatgaagtaatgacactatcaacctggtcatccgtcaaactcccagtagtttgagacgcgcctgaactgcttgaattgctatttgaattcatgctggaactttgagatgtagtcgagctactacttgcaacacttatttgattcgttaaagcttttccttgctcttgaaggtttttaatccctctaactgatgaaggcaacgcatttaatttagccaaatccgctttagctgtttcgtagtatccatttgaaacagcatcatatgcattttgataccacctatttgcttcttttagttgagcggatttggtgctcaaatctttagcttgtgaagtcagtgcatccccgtttgtcttttctgacgtcatttttgccaaactagaatttgcagaatcagtatcaccactattcagtgcctctttggcggctaaatagttttgaacatttgcaagtaattcacttactttactatcattattgtttaagctttgcgctttttttaacgttgctagtgcattacttgtttgtccattttcaatttgcttttgggctttttttaataaagctgaggcctttttttggttggtctgcgttgaagtggcagaagacgacgagctacttgctgcatcactttgtccaccattactgcatgcaaccaaagaaaacagcataacaacagcagctaccccaactaagctcttcttaatatttaattgtaaggtcatgattttctcctccttgacgacattataccatgttccacaagttaattaataaacgaataaccagtagattaaatagctaattgtcagggtagccaaaatcatagcatttgtccatttaaacatcataaataaagccaaatattctctaaaagctgcaaacggaagataatggatggatgtcgacgcactaattccagacattgttgtatgcaatcgtttcgcaataacaccagctcgaaacacgtgaaaactgtttgtaacaaaaatggctcgatgaaaaaccttttcctttgtcattaatatttctgaattatataaattctcataagtagaggttgaagcattttcttgaataatttgagatttagcaataccgttttctatcaagtagttgcccatagcacgactctctggcatgatttcatcggaaccctgtccacccgaaaccacaaattgcgggtgagcccctcgttttcgctgctgtttgtatattgcaattcctttatccaggcgtcgctggagaatcctcgaaacactgccatctgccagtagacccgctcccaaaatcacaataaaatccacagaatacagaataggcaattcgtccagcaaagaagacaacgcatatgaaagaaaaccaaccatgagatagccgatccataaaaataaaataccaagtatcatccatataagatgactacgaaaaaatagcgaatttagtagggttacaataagcatgccccaaatcacaaaaccaatagtttctaacatgacgtaaccaagttgtgaacccgaataacgaataagtcttctactatagagcacacaggcaagtgcaaaaaaggctaaagcaatgggaataattccagtcaggactaagctcgtaatcaacatcatagcttgcatccaaggtgcctgagtcacttcaagccactgccaaactgcaatcacaaaacatatcagcccggcaatcaaaaaataaccatttaaaaatcgacgccgatcagtaagccacaacgtgataaaaactgctaaacaaatgctgccccaataactaaagtccatctttgtcacttcctctcctattttcattttagaatgctttcgagattttttaaactttaatgtcgttatttaattgtagcttttcctataccgcaaaaaaaagataaaatcaagtctttcatttttttaatttcgagatacaatatatagtgttgtttggttttgaaatcggaacatattgtgtacggccgtatacatagaaacaagagaggaagataagcaaatgtctaattatttacactttttggcacatcaattaaagggttggcctcaacaaaactactatttattctttttcagtcttggttgtcaaatcatgactttggtgaattcaccaattacagctttaacaattactacatttattggaaccacattaggtgttttatgtattttagcaatcaatgccgcaaaatcagttaatggttggttaggattattatctgcattatgttttataatcacaggttttgcagcaaaaaattatttaagtatggcagaacagttggcttacgttgttacacttgatttaccagttctgatgagtgcaaactggaacgttaacatggtttctaagattcgtaagttcactggtaaaacttggtttgtggcattagcttcaacagtggttgtttactttgtctctggttacctaatcggtacattcactaatgatcctcgtccatgggttgacgccatcagtttttcaattagtttaacagctggtgttatctgcttcctccgtttcaacaaccaatacttctggtggtttgcttcaggaattgcacaaatggtcctttggttcatttcattccgtcagggctcagctacattagccatgtttgtaaacagttcaatctaccttattaacgatgttttagcatttacaacatctccatggtacaacaaaaaagaacgtgcacgtcttattaaggaagaaaataattattccgaaaaagaagaaaccgttggtgacgtgacacacgcctaagtccacatacaaaaacaagcgtattttgggtctctgtcacattccacctgttccgaaaagcaatgcaaacaaacttcagtccatgtttgaaaatgcgcctatgcctgaaaatcctacatcggttggtgacgatgtcttccttactcaggatcaacgggagggtactactaccccggctagacgcacctctcaaagactgaagaacaaacttatccagaagatgaaagataagaataccaacacaccactccctcccaaaccgaaggttacagctcgtccatcgctgagacgttcattaccccgcgctgctaaagctggtaaacatgttgttaagaaggttaattttgtcatggtcactaatatcaatgtcaaagttcccattcaagctaagaccccgtttccaaagacttaccaatctgcaatgaactctgttgatcatatacactggaaagctgctgccgatgctgaattcagctcgcatgcagaacaaaccacctgggacccaaagcctatatttgttgctaaggattctccattactgaagaagacaattatgactaaatgggtttttactatcaaaagtgacggcacttacaaagcccgtcttgttgcccgcggtgacctccaggatgattctacttatgacatcacatactcacctactctacgtccagagattgctcggagcatcttcgcacaaaatgtcactaatggctggttcttcaaacaatttgacttcaaaactgcttacctcaacagtctgctgaatactgagatttatatctatgcaccagcgggatattcgaaacacaaacagaagagtgatacgaataagagggtgatattcaaactgaatagaggtctatatggtttgaaacaagcaggtcgattatggcacctcgaattgtccaaaacattggcaaagatcggctataaaagacatgatgcattcccgtctactttcattaagaagggaagaaatggacaggttatatgtgtgataggtctgttcgttgacgacatgattgtgagtacaaaagagaagtctgaaatgcaaaagttgagcaatttcctaagtgagcactacaaactcaaggagattcaagctgatgaagacggcatgcaacggtttctaggtatgaacttgaaggttgaaagatgtgaagaaggcaaaaccttatcaatcaacatcaaccaatcagaatatattcaatctatcatagatgagtataatgttgaataccgaccaaaaatcaagacaccattgccacctggattctattttgattcctcattgcctgaaaatcaattggcaagctcagatgctgcattgaaagtcgccaaacatgagtacagaaagaagatcggtttactcctgtatatatcggttatgactagaccagatattacatacgctgtgaactacttagcacaattctgcgaataccctcacccaacattatttacaataatcgggagattgttcgaatacctaaggaacacgcagcatttctcgatacgatatgaagatcataaatcagatttaatggagatatttaccgactcagactatgctcaagaaccgactacaagacgttctatgaatggctacttaatcagattaaatggaaacattgtccactggaaatcaaaatacacagcacttatgtgcactagttcaactgaagctgaattacaagcaatctttatcgcatccaatgaaggaatatggtttagacaactttgtgtgtttattggattatttccaagaagtcaagtgggcaaatatagagttgacaatcgctctatagtcgacgcaataaacaacgataacttcagcgcaacctcgaaacactatgcagtgagactccaaacagtcaaagaaaggttgaaggaacctgatcttgacgatacgttcagtaccggaaaaatcagatttgatttgaatcacatttctggtgaagatcaactagctgatattctaaccaaaccaataactgttaaggtcttggagaagttaattccactcatcatgaatactttatcaggatagtgaaattaagagggtgtgtcgctccccaaatccgccgagccgtcggttaactaagttacccgactttaggccatatatgggaaggcgcaagtgaaaaatgtggattgacggacgtcgttgctacgctcgccgcgtctccacacagtgtgtcggtacaagcaaccgctacttgatattctactgtctttctactgaaccattaggttcacgtaatacatactttgtatatcttcctttaatatctacttatctctctaagatatacctatatcacttaaggcctggtctgaccccttaggaacgcttactggtacgtttaccataggaaaccaacatgcaatgttagtccatgttatgacacacacataaggtacaaccgttggatactacactagactgctattgtatagcaagagaagtatgatcaccccccggatatcatcagcacgctaactcgttttgtacctggacagattgaatagaagggctcaatcttgtcccgcgagtcgatatcaatttaaatagcgacatggcacccatgctgggagaatggaaattgtgtcataactgggtaatatatgtctattacattcttaattcttttcataagaatagaatactaactattgcaaaacatcccgttttcaaaatgacaattaagttaaatacagttagtgttgaaaaatgtctgattctgattctttacactctgcaattactacaaggtattggtcatggcagtgatttcaagaagtttgaggaagttaacctggattacatcgatgttccttgtgacataatcctcggcgactacatctccaaaaatgttttcgaagatatttaacgcttacgatagagtattacttttttacaaggaaggagaacaagtctggaattactctaatgtatttcattctgttggaaagaatgttgacaatatttatcggttcaggaaagacaactgtgcaatacaaaccgggaaactcaattcgaagactcacttttggtgaatgtatcgacagtaccgatgttgtgaaagatatggtattctttgttgaattaacggaaatcatttatcaatcctaagcacaaattttccaatcgtcaattacttgatgtgattaccgaaaatatttcattagacgtcaaaaaggagttaagaaacacgaagaatgagacacgggaacatattcgtcaaattttgagaatttaggcgaattctcttccacactagatatatatgttacggaagagaaacctcagagagttgactctctaccctttattccccctgcaccataagaactggtcgaaagacagggagtgaataccatgactgaaggaggttggtgaaaactcaatcagtcaaaaagaccaagaaatggaagaaacaccttaaagaaggaaaagtcagaaggagcaatcaagacttctacagcaggcgctattatagtcagtcacaatagtgttacacatgatcctgttgaagtacatcctgttgaagtccaagcgtcgaatttatccgcgaggcacttcacggtttatgattgatggtggttcccaaataacaatttgcaatgatattaaattcttacataattatagggaggaaaaaccaagtttcaacgccgaaagtttcagtggacattctttagatctcaggggatacggatatttgattttgaattttgatgatttttatttccaattgcagtgctggtatcaacctgatgcagcaatcaatcttatttctggttgttatcttgacgaccatgattgcatggtaaataaaattaactcggatccaaatgagtatgtgcttcagtacaaacaaagatccataccaatcataacggtagatgggttaaaattcattacatcatcagaaatcatcctaccaccagagaaaaagaaaatatacagtgtccacactagactaggtcacataaacgccacctatctcctcaggtccgattttcacggtacgatccaaggtatcaacgaagacgaccggactaagttacgctctttctacactgagcatgactgtacttcctgccttcttggcaaagcaagacgagctaacgccgtcgaatcatcacgagacagatacatagatgtatcgccattcagcattgtctattctgacgtctgtcaaatcactgaagtactacagcccaacaggcaaaagtatctcgttacattcaaatgtgcctcgtcaaattttctgaaaatttacccaatcgaaaagaagtcggatgtctatttctgtattatagcattcgtcaactgggtcagaaatcaatttcacgacagaggttacagggttctcaagttgtttactgatcaaggttcagagtacatgagccagcaagttcaagaattactagctcaggaggggatagaaagtcaaactacctccgcctatactccacaatcaaacggtgtcgctgagagggtgaatttgacaattatgaacgatgttaggtcaatgttaatcagttcatccctaccatcatatttttgggtagaagcagcactgtattcagtatacttacgaaatcacatttacatggataagttgaagacttctccagctatgttcatagggttcgacccattgaacatcgatgacgttcatgaattcggtgagagatgttatgttactagtctaccatatggtggtaagactgacatgagaggcgctttaggtatctaccttggcagatctgcagcagtttttggtcacagagtttttgtgccaacacagaacggtacggtcgacgctggttatttcctttgtaccaggcatgtcgaattcaacaaagtcccaaaactgtattttgcttatcctcatgacaaacaacatgaaaatactttattcaccttatttgataatccgatgcatattggactagaacaaaatcgagaacgtgatgtgaacttggacgaatatctattcagcaaatctggatcgaaacgcgatacacaaattacggacggtgattccgacctgatggatgtagattactccagtgatagcgacgtcagcatggatgactaccatgaagaaaaagacgacgatgatgaagatctcgatgatgaaaacttccaactttctacaagcacactccacgatgacgcggatatggagttaccggttatcaacgagaaagaattattggaagacaccaactatctacttacggatatgatagatacgttggaggataagatgaacacttcaaatacggaatcaattcagatgttccaacaaggtttaaacggtcaaggtagacacacgagaagtagtgccagagcgaggttaggtccagtcggggaccaggatccactagaaggtttatctggatacgagacaaatctagctccaagtccacaagtacatttctctgatcaagttatggaaaacgctgctacaacgacaaatgacagttctcatccaggtattaccggtcccgtgggagtgctcccaccagtaacaggctcaactactacagcatctcttcaagaaccacttattcaagctatgagaacacctccagaagcaaacgtatcggatcatcaatacgtgaatatagaggattctgtgaaagaaactaccaacaccaaattggctcttagtcaaccgtcaaatgatttgagttcgatacaagaaagtgcaccatcagaaccggtcactcataagaaaccaaccctgatgctcacatcgaatgagacggcagaagattttacttccaatccaagtgaatctagcggaacaaagccaaagctcagctcaaaatcatcgaagactaaacgaaccaaacctacccggaaaccaatcaagaaggactccaaattgaagaaatcatcggatacaggcaagttatccacagctaaatccagcacacctgaaccggcaccaccaaaagaagaagttatgctagactctgagaggccatcaactacagagactgcagatgctgcaacgaaaagtcacagtcattgggatcaagataaaccatccattctcgctatgtcacaattatctccccaacattctagaagaaagactgactcaaaagccctagaggacgattctattaccacaactcaatataccgcttctagaaaccaagacgcaacaccagtaccagatagtgacatctctgccgatgctggcgttaccaaggaatcaccggctgccaacttaagttcaggaacacctagttctacgggtcttgacaaacccgtgactatgactccattcgaaatcactaacgatgatactgcagttgcacgcagaactaggtccaaacaaactcgtgcattcgtgttagatgatcgtgtcttaggaaagaatgtgagctcaaaggtcagaaagcctaagaagaaaaaggctacttctgcaaaggattcatcaatggtcaaccctagaaaagtcgacaaactaccaccagcagttattgatacctcagaagatcccactccattagtcaaccgtttgcataatgttgaaccacttgccaaaattcaaccggagcatcacatccaacctcagaagaaactaacgctaactccaacttagaaaatgaactcgctcacaaattcaaattaaatcgaaagaaacccaacaaactatccgctaaaactggagacatgacgactacgcggcaaacaagatctaagactgctgctggtcgaattcacaaagactacaaagtgaaatcggtcacactccatattttatcaactacttcggttcctatcccaaccaatatctctcgttttccgaagacttacaaagctgccctccaacgtcccgacaaggacgcatggatcaaggctgcagaaggcgaactcaattcacttactggcatgaaaacttggactctcactcccgaaatcgttcctattgattctcctaaattgaaactcaccattccaaccaaatgggtattcaccatcaaaggtgatggtacctataaaggtcgtgttgttgctcgaggtgatcaacagaagcactccacatttgatcaaacgtattccccaactttacgtgccgaaattgctcgaactattctcgcattgtctgctactcgtcgttggtatactaagcagtttgacttcaagactgcctatttgaatagcaaattggaccaagaaatttacatttatccgcctgatgggtatccaacggtttctcacccgtcgaatacgagggtgatatacaaactcaatcgtggtatctatggtttgaaacaggctggtaggttatggcatttggaactttccaagacgcttaagaaacttggttacgtcaaacatgatgctttcccatcaacgttcattctcaagaaagacaataaggttatttgcatgattggtttatttgtggacgacatgattgttagtgctcaacaccctgacactctgaccactctcagtaaggaattgtcaaaggtctacaaactcaaggagatctcatgtgatgaagatggaatgcagagatttctcggtatgaacttatggattaccactacggagaaaggtaagaccagtcagataagattcaaccaagaagaatacatcaaggatatcattgccaagtacaatgttcggaagaacgtcaaaattcagactccattaccacctggttactacgtggacgaagaaaaatacaaaggtaagttattcgcaactgaaaatgctttgaagattgcaaagaaggaatacaagaagagaattggtacgctgctatacttatcggtaatgactagacctgacatcacatatgccgtcaattacttggcaaaattctgtgaattcccgcatccagatctgttcaatttgattcagagggtgtttgaatatctattcaatacaatggatttgtcacttgtatacaaaccaaaagaggaaaaaggtcttgttatttacacagattctgattatgctcaagatgttaactcaagaagatctatgaatggttacactatcagagttaatgcttgtacagtttactggaagtcaaagagcacagatttggtctgtactagttctaccgaagctgaacttcaggcaattttcatagcaacaaatgaaggtatttggtttagacaattattagtgtttttgggatgttacgatagaaaatcgaaggcacacttccttgtggacaacaattcgatcgtacaatcaatcataaatgatagcttcagccaagctaggaagcattatgctgttagactggcgagtgtcaaagacagacttactctgcctgatgttcacgatatttttgcagatcccaaaagtgccagattcgatgttacacatgtcatgggcatttatcaacacgctgatgttttaacaaaaccaattactgtcaaagttataaaagagttgattccaatgatattcggttgatacaaattcatgtgaaatcaagagggtgtgtcgctgcgtggaatttccatgttgggcaacccgcattccagcgacagcgttgggcgacagtcgtcgactctggagagaattttctcctcagtttcgtcactgcccctatgataggttgtccttactgtacgcacacgttatagtattatttagtttctttatacaacgacttaagtctcattctacatatctaaaggaataaccaccccccctctggaaagaaactattcccctagtcaactgatcattgatattgttcatactcttacaggtacaatatattctactggtacgtataactgttacatactaacgtgggacatcgttcactcaataccgacggaaaccgggcaagtaccgaaaccagaaagtgcggctacacttataggtgctcggcgtattaaaattccgatatggcacccatgctgggaggctcgaaggattgtatgaacatccatgatcaccatagttattactagggactaacaatcctagtttctttccagaaactctttactaacacttctgttacaaaagctcctacagttaattaaaaatgattccatctacccaatcccaaattgctgatctttatgaaaagttcgaaaagctctcaaccgaagttgctgaattgaaaggcgaactcaaggagaaaaacgagttgatcaaagtcttaactaagttggcaaacagagtcgataactctgcaactaagaaagatgcacctgagaaatcagaggaagactcatctgattctccaactgaagagaaattatgtgcacttactcttgagggtgttaaagcgagacttccaacagtcgatcgtattcactctatgttgcgtgttcctgcaaagttctctgggatcgcagagttcttggacttctacatgaagttgaagaatattttcaaatcacttggttatgagaagtctttcgaaatcttcgaaaacaaaggtattaaaggtattaagcagattaagacatccgatgctttcattttgtcgaactacttaactacctacttctacaaaactatcaatatagaagttggtgaagtactttatgaagaagattcagaattggatgaagaaggagattatagtaatggtttcgttctactgaacaagttgtgggaaaagtttctcggtaagcgtgaagaatccattgatgtttatccattgatcgaaaagattaagatcggagaaaactatgacaaacctgaggcagtcagagcaactctcaaacatatcagactgatcgcggaaactcatgcgaagactaaaccttacgatgacgaaagggtagcgcaaaaactggcaggagctgcatcgaaaacattcaaggatggagtattgaagatgcttgaaaatgcaaacactccacatacaaagggcttcatatacagatacgaaactgttgaatcattattagctgatttggagcaaataaacttgaagaaagtgatagtaaagagcgaaaccttagatccagtttcggctcctaacaaaagactcttgaattacgagtcgaagaaggatcacaaatcatctgatactagagcgcagaaccatggtggatccaaaactagtacagttggttcaaacaacagcaaagctaaaccaaccaaaccaaaattccatcaagccacaaaaacactcactaacaagagtatcacccttcaccacatcaaagaaaaagatctcgtacttgcggatgcaactgatgttactgcgaggccttggtgaacccgaagatatggtccagatagatggtggtgcagacctcagtgttgtgaatgatttatcactactacaccactacagaaaagcggaaccagagttcactctatgtgacttcagtggaaatgttattgaaggtattgaaggttatggatttctgatcatagactttaacggtcatcatgtctccacaatctgctggtattctcctctaactcaaagcaatattgttgccgatgggaagttgaacgagaaaggcagtgaactgagattgaccaatcaagatccattagaatatgctctaacctacaaaaatgaaagtattgaactcttgacattgaatttgtcgaagtacctcagttacgatcacattattagaagcaaacctattctcaaaatctgtgatatacataccaaattaggtcacattaacggacggtacatcttaaaggctgcgagagaaaataagatcgtgggtgtctctgaatctgatatccagagactaaatgaatatctcaccgttgatgactgtgactgttgcttgattggcaaggctaggcgttcaaacgctgttgaagggtcaagggacccgtatctacatcataaaccgtttaatgttgtctactctgatatctgtcaagtcagagagttgaaacataacgaaagggctgtttattttgtcagttttaaatgtgcaattactggatttgtcaagatttacgcaatgaaaaagaaagaggaaacctatgactatttggttactttcgtttcatgggttgaaaatcaatttggcgctagagactgcaaggttaagaagattttctcggatcaaggaaaggaatatctgagtgagagggtgagagagtttctcaagcaacgcggtatcgaaacccatacgacatcagcatatacacctgcttcaaatggtgtcgctgagagggtgaatttgaccattctgaacgatgttcgtgcaatgctcctcagctcaaaacttcctcccttcttctggatagaagctgctcactacgctgttttctttagaaatcacatgtggaactccaagatcaagaactcacctgctggtgaactcggttatgcaccattggatatcaatcgaatttacgaattcggtgaaaagtgttttgtgaaaattctgcctgaaggaagtaagactggaccaagagcttataccgcaatccatctgggttactcggacaccacttatggttatcggacatttattccgacagaaggaagtggattgaccgaaggaatatttcttgagacaaggcatgttactttcttgaagacacctacactatatatgggaaataccgagatagaagaagatcacttggagacaatgctggacagtccaatccattcagacatggaggaggattaccctggctatattccgacttgcaagctagatgacatcttgtatgacattacacatccatatcaaactgacagctccaatcaatacgagtcaattgatgaaagcatggacatagatgatcccgatgatgaagattaccaaatacctatacggatcagagaacaagatttcaaagaatccgaattagacctgcaagagacagcaactatgcaggccgaactaagggaagatgcaagagcactcccggaagagatgagtgaagaggagctcaatttatacagagcgaaaatggagtttgaggatcaactcacagcctcgttgtccacgagagacaatggccagccaattcaggttggtgataacgaacataaaactcatacatcttttttatcggtagggaatacagaaggcaatactcattccactcccgagtctgcggtagcaacaaaacttgacagtgactgtggtaatacgaaggaaccaccaaaatccttccccaacgatacttctacttattcacgttctatggctggcgcccctcaaaccttcgagactccgcctatttcatcgcaaagccagtcgaccaatcagcaaatcgcgaatgctgacaaaggacacaatttagccaaaaagaataaagtagctgatcagggtacccgactaaatgacagccagagcaagcagaaacgccagagcaaaaagtcaacacttcaagcaaagattgatgatggtaaagagaaggcacaaagcgatacaccatctccaaaaccagtcacaacacctgtggaagctccccttacgaaaccgatcactcccccgcctaattcagaagagtcaagcccacacttgacacaaactgcttcggctacagctccaaaggccaccaggaagactagatctaaaggacctgtcactgaacaactcgatgattcagtcctggatagaaagaagcctaccaagaaggacggtagtcagaagttgacaaactctgtcgatcaaagcacaaaggagtctgatgatcttgctgttggaccaagttccagctcacagacccttacaatcgagcaaaagagtcataatgatagacccgagttagaagcaatttatgctagtacgttttcagatgatgatgaggatgacggtgattatcaagatgctacagaaggttatgatgatgatgacgacgccgacaacttttctgatccggacaatgaatacagttacggtgaagccattgaagtagacgaatatcacattccctacacaactcagcaatctactgagccagaagatccagaaattctacgcgcacttgacgcatcactagcggaatatttcattgatgaaccattaccaagtgaagatactggactagatcatggcaataagttttttttcgcataacccccccgaaaatacatataagcggggggtgtcactttttggtggtactcctctgcagcggcgctctttccggcgccgttcagccatacgcccgtggaaagtttgcagggcggtcttcgggccgcgctggggacggccggggccacgagaccatctggtcttgcacaggggcgtgctcgtcttgcgacgggggcgcgcactggcggggttggtgggctgctagccaatggccagcggaacactagcacacgggacgaggggccggcgtgtagccgggggcggcgcctttcgtgggcgcatcgtctctgtgacacggcggcctacgccccactgacgcgggcgaagccagggttctcctgggggctgcccggggaagaaagtcgagaggggctatgtgtgggcatccgcctcgtgactatactcatcgagcgtagttatctggttgatcctgccagtagtcatatgcttgtctcaaagattaagccatgcatgtctaagtataagcattatacggtgaaactgcgaatggctcattaaatcagttatcgtttatttgatagttccgttctacatggataaccgtggaaaatctagagctaatacatgcgcaaagccccgacttcgggaggggtgtatttattagataaaaaatcaatgccctcgggccttttgatgattcataataacttttcgaagcccatggccttgcgccggggctggttcattcaaatttctgccctatcaactttcgatggtaggatagaggcctaccatggttttcacgggtaacggggaataagggttcgattccggagagggagcctgagaaacggctaccacatccaaggaaggcagcaggcgcgcaaattacccaatcctgacacagggaggtagtgacaatatataacgatacagggccattggtcttgtaattggaatgagtacaatgtaaataccttaacgaggaacaattggagggcaagtctggtgccagcagccgcggtaattccagctccaatagcgtatattaaagttgttgcagttaaaaagctcgtagttgaactttgggcctgggcgggcggtctacctatggtttgtactgctgcggccgggtctttccttctggctacccctccggggggaaccaggacgattactttgaggaaattagagtgttcaaagcaggcctttgctcggatatattagcatggaataatagaataggacgtatggttctattttgttggtttctaggaccatcgtaatgattaatagggacggtcgggggcatcagtattcagtcgtcagaggtgaaattcttggattgactgaagactaactactgcgaaagcatttgccaaggacgttttcattaatcaagaacgaaagttaggggatcgaagatgatcagataccgtcgtagtcttaaccataaactatgccgactagagatcgggtggtgctttttgcgcactcggcatcttacgagaaatcaaagtctttgggttctggggggagtatggtcgcaaggctgaaacttaaaggaattgacggaggggcaccaccaggagtggagcctgcggcttaatttgactcaacacggggaaactcaccaggtccagacgtaataaggattgacaagttagagacttctcttgatcttacgggtggtggtgcatggccgtttttagtccttggagtgatttgtctgcttaattgcgataacggacgagaccttaacctgctaaatagggctgcgagcatctgctcgtgggctcttcttagagggactatgggtatcaaacccatggaagtttgaggcaacaacaggtctgtgatgcccttagacgttctgggccgcacgcgcgctacactgacggagccagcaagcataaccttggtcgagaggcctgggtaatctcgtgaaactccgtcgtgctggggatagagcattgtaatttttgctcttcaacgaggaattcctagtaagcgcaagtcatcagcttgcgttgattacgtccctgccccttgtacacaccgcccgtcgctactaccgattgaatggcttagtgaggcttcaagaccggcgcggcctgcggggcaactcgcgcgctgcgctgggaatttagtcaaacttggtcatttagaggtcgtaaaagtcgtaacaaggtttccgtaggtgaacctgcggaaggatcattactgtgatttatacaccacactgcgtgggcgacacgaaacaccgaaaccgaacgcacgccgtcaagcaagaaatccacaaaactttcaacaacggatctcttggttctcgcatcgatgaagagcgcagcgaaatgcgatacctagtgtgaattgcagccatcgtgaatcatcgagttcttgaacgcacattgcgcccgctggtattccggcgggcatgcctgtctgagcgtcgtttccttcttggagcggtgcttcagacctggcgggctgtctctcgggacggcgcgcccaaagcgaggggccttctgcgcgaactagactgtgcgcgcggggcggccggcgaacttattaccaagctcgacctcagatcaggcaggagtacccgctgaacttaagcatatcaataagcggaggaaaagaaaccaacagggattgccccagtagcggcgagtgaagcggcaaaagctcagatttggaatcgcttcggcgagttgtgaattgcaggttggcgcctctgcggcggcggcggtccaagtcccttggaacagggcgccattgagggtgagagccccgtgggaccgtttgcctaagctctgaggcccttctgacgagtcgagttgtttgggaatgcagctctaagcgggtggtaaattccatctaaggctaaatactggcgagagaccgatagcgaacaagtactgtgaaggaaagatgaaaagcactttgaaaagagagtgaaacagcacgtgaaattgttgaaagggaagggtattgcgcccgacatggagcgtgcgcaccgctgcccctcgtgggcggcgctctgggcgtgctctgggccagcatcggtttttgccgcgggagaagggcggcgggcatgtagctcttcggagtgttatagcctgccgccggcgccgcgagcggggaccgaggactgcgacttttgtctcggatgctggcacaacggcgcaacaccgcccgtcttgaaacatggaccaaggagtctaacgtctatgcgagtgtttgggtgtgaaaccccgggcgcgtaatgaaagtgaacgtaggtcggaccgctcctctcggggggcgggcacgatcgaccgatcctgatgtcttcggatggatttgagtaagagcatagctgttgggacccgaaagatggtgaactatgcctgaatagggtgaagccagaggaaactctggtggaggctcgtagcggttctgacgtgcaaatcgatcgtcgaatttgggtataggggcgaaagactaatcgaaccatctagtagctggttcctgccgaagtttccctcaggatagcagaagctcgtatcagttttatgaggtaaagcgaatgattagacgtctcggggtcgaaatgaccttagcgtattctcaaactttaaatatgtaagaagtccctgttgctttagtgaacgcggacgattgaatgcagagcttctagtgggccatttttggtaagcagaactggcgatgcgggatgaaccgaacgcgaagttaaggtgccggaatgcacgctcatcagacaccacaaaaggtgttagttcatccagacagccggacggtggccatggaagtcggaatccgctaaggagtgtgtaacaactcaccggccgaatgaactagccctgaaaatggatggcgctcaagcgtgttacctatacttcgccgccacggttgtgtgccgtggcgagtaggcaggcgtgggggtttgtgacgaagccttgggcgtgagcctgggtcgaacggcccctagtgcagatcttggtggtagtagcaaatattcaaatgggaactttgaagactgaagtggggaaaggttccgcgtcaacagcagttggacgcgggttagtcgatcctaagagatggggaagctccgtttcaacgtgcgcaattctttgcgccaccatcgaaagggaatccggttaagattccggaacttggatgtggattcttcacggcaacgtaacagaatgcggagacgccggcgggagccctgggaggagttttcttttcttcttaacagcctatcaccctggaattggtttatccggagagggggtcttatggctggaagagcgtcgcccttgttgcgacgtccggtgcgcttgcgacggtccttgaaaatccgcaggaaggaatagttttcacgccaagtcgtactcataaccgcagcaggtctccaaggttaacagcctctagttgatagaataatgtagataagggaagtcggcaaaatagatccgtaacttcgggaaaaggattggctctaagggttgggcggctgctggccgttgctggctgctgtgccggcgctgctgctctctcgggggcgggcggtgccagcgcggcgtgcttgcggcggactcccggcgccgcggttaacaaccgacttagaactggtacggacaaggggaatctgactgtctaattaaaacatagcattgcgatggtcagaaagtgatgttgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctatctactatctagcgaaaccacagccaagggaacgggcttggcagaatcagcggggaaagaagaccctgttgagcttgactctagtttgacattgtgaaaagacatagagggtgtagcataagtgggagcttcggcgccagtgaaataccactacctttatcgtttttttacttattcaatgaagcggagctggtcctcgcggccacgttctggaacgaaggcgccttgtgcgttgatccgggttgaagacattgtcaggtggggagtttggctggggcggcacatctgttaaacgataacgcagatgtcctaagggggactcatggagaacagaaatctccagtagaacaaaagggtaaaagtccccttgattttgattttcagtgtgaatacaaaccatgaaagtgtggcctatcgatcctttagtccctcggaatttgaggctagaggtgccagaaaagttaccacagggataactggcttgtggcagtcaagcgctcatagcgacattgctttttgattcttcgatgtcggctcttcctatcataccgaagcagaattcggtaagcgttggattgttcacccactaatagggaacgtgagctgggtttagaccgtcgtgagacaggttagttttaccctactgatgaatgttgtcgcaatagtaattgaacttagtacgagaggaaccgttcattcagataattggtttttgcggctgtctgagcagacactgccgcgacgctaccatctgctggataatggctgaacgcctctaagtcagaatccatgctagaacgcgacgatttttgccctcgcacatttgagaaggatacgaataaggccctcgggccgcagaaccgtagcaggccggcagcggtgcgcgtggcggaaaggccgcgtgtgcttgccggcggatagcaatgtcaggatgcgcgaggataaatcctttgcatacgacttagatgtacaacggggtattgtaagcagtagagtagccttgttgttacgatctgctgagattcagcccttgttgtccgatttgttgcttcggcggcgaagttgcggctggcagacgctggccggggaattttcgcggcggaaagattttggggcggcttggtcgagtgtgggcggcgccttgggagatatcctgattactagggggtgatgcattgtgttacctgtaacagaggggagggggggtaggaaatgcgtcgatcgacgggggtgaattttgtgcacgtgcgcgattctggcgagagtaggggggatctgcaggaaatgggcggtttagtgggggtaggggccggaacggggcggcagagaggtcgcagaggctctgtggggcgagatagcgtgggtaggggccttgggagcgggcgtgggggcagcgacgggtcggcgggggtagagttttctggcgcgggcagaggcagaggcagcggcaaaggcagcgagcgcatgtccggcggcgatcgtcgggcttttttgttggccgtggcgggtcacgtgcgcgggcgcagggcggcgcgagccctgggttgtgaaagcgacgctgaactccgaatctcttgacagatgactactccgagccctccggtccctcccctcctgctgtcctagtagggaatgtttgccgatatccgaagaaccaaatagcttgaaatagccgaaaaactgcacttttcctgacgtcccccaatttttcgcgaaagccataactctcgcagagagaccctcgcagagagaccctagcacacaccatacacccatgatcagcatcaccctagttctcttgctttatcactggtagtgcacggactacataacggtgatgctgagatatagctgtcttaggctcgctacttccaatgcgccactaaataaactggggaaatgtataggattcagtgcgtagacccaggtggagcaacatcttcccctcatacgagtgcggttaatgctacttcgcaaatacagaatcattatctttcaaagctggttgattagaggctacgaaacaagaggagtagcttctagcagcaagatgcatagactgctcgtagtgatgtaggaacccaatagtaaggtatgatgtcaacagctcatattggctgtggccgtattatggcttcatatttcagcaatttcatgacttctaaagacttgcatttctcttgaatattggcaatttaggcacatttaagagcctatataagccatatcatgcgaaagaattttaattgattacaaactaaacaaaattctgaaagcaaataccattttttggaaaaatttttttttttttttttcaactaataatgttattactatacgctataaaagatacttataagttttctctattatatcattgtgtcagaaacacacaagtaagcactattgagtgatagtgttatatggaaagggaaaggtgtgtgtcaccaataaaacccttatgaaaaacgaaataaatgtggggggaaggtgatcatggacatgaaactgtgttagtgattttgtatggttgcactaaaatgaaagtgcaactcttggagttcgtcatcatcctcccactcaatcatcggttccatttccctgtcacgggcataggcccttttgtgaaagtagagaagaaaaccgataaaatgattgagtgctcgaacagtggcgaaatcatggagggtgggaccaatgagctttggcggtggtgagttgtggagaaagctccacagagctttggtgatggggcaatgctggacaaaatgaagcattcgctcttctgttgcattccatccacatggacatggcagaaagaagcgatgattcagcatgccaacattgagggcatagatgaggtagtaatgatgaggttgatgaaagatgaggctagccagctgtttgaacacccgccgccattcttgcacggggatatgtgagctctcccaagtgtgggtgatgagtggaatgtagttgcgtcccgcgtggagtctttttgagagatgtcggaatggattactttcttcaaggtcctcgacggtttgctgtctaaattctggttgtaggtgaaggtgggatagttctgaaaatcccggaagttgaactggattgtccatcagctttcctaggtcagcgggtaagatgcggtcggttgggatttgtggttcagatgtgattttttcccatgcttcgatgtaatgttggaagtttgggtatgggtggtagttgagggggaggctgacctgtatgtggatgtctgtgggaagttgaaggtcaaggggtgccgcatacggtcccatatacggcgggacaatcaagagttccaagtaggccctttcagcttcatttcgttgtcgaatttcatcatttctatagtggttgcgaaaggcttgactgtaattgactgtgatggtgtagttggctgttgcttctagctcggtatggattgcggtccccggtgtggtttcatcagtgactggcctaaagagaaaccatggggtcaagccggtttgaatcacttctgttgttgatttattgactatgaagggaggtggtcgggtaatgcgatctcggatgtgtacggcgacaaaatcagtaagcttttgccggtagtagtgaacatattgaggtgcaaagtttcgaagttgtaacgcaagacgcatgagcgtggtgagatatggatgggggtggggtgtagagtgagggatgagcgcatattggatgtaggttgctctccttcccagtagttgagttttgagatccatcattccaaatcccccttgggatcttggaatgtaccatagctgggagtaccccgaaggcttcggctcaacgcgtgagatcaagagccttttaatttcaaccaggaagtcgtcgagcagcggcattgagatggggtcatgctgctcgagaaagtagatggtggagaaaacgtaggtgttcattcccagaaccctcagatgtataggaaggtcccagaagtttatccggcgggccctatccaccaatagcttcagtttcgtgtgccagtttgtagaaagaattggaacccctaagtagatgggattttcctcgatggtttcaattttgagctccccagggaaaagtcgttcaatttcgtctctttgattgccattgcagtaaaccttggtctttgtggagttgatcttgagcccactgatctcatggaaggaggtcaagatggagagtgtggtggtgatgtcattcacatcggaattaaaagtgataaggtcatccgcaaaagcctgtactcggcaggtggtggttagtggacaatgataggaggatgtggctgggacctgtagggggttgtagatgatgcctttaagctgagcattgagtctcctgatgagtggttcaaggcagagattgaagattagaggtgaaatcggcagcccttgtcgaacaccgcgcttcatgaaaatcggtttgcgaaaaacaaatcttccgttgaggagttgagcttttcctgtcttggactggtaaaggatggaattgatgaaggatgttggaagtccgaacttctgcatcacgatagggatgaaggcatgcgagagcgagtcgaacgccttttcaatgtcaatcaaaaggagtgagtgcttgctggctggttggtttgcaatgtagtgggagagaatccgtgttgactgaatgttatgatggatgtctctgccctctagaaaggcttgttggtgtggggaaatgatgtcattgaagatggccatgattcggttggtgtatgagaagttgatgatgcggaagatggtgttcgttaatgatattggccttagtttggaagccattggtgattccttgtacccttttttggggatgagtttgatgagagtatcgaagatggagtgcgctgtcgtgagcggatgttcagaactcatagtatgattggcaaaaagcgtcaggatcccttttgcttgttcccatcccttgtaccaagcctgatatgtgatcccatcggggccgggagaggagggtcccttcttcaccagggtttggaggttttggaagagctcttcttcggtgaagctttgatggaggcgttgctggtcctcagctgagatgtgtgaggtgatatagccggcaaaagaactgtcaaagatattccggattgcattggaggagtcttcagtgggtgtttggtaaatactggagaagaggtcatgggcttcattaatgacggagttggtgaaagttgtttgtgcaagtttggtcttaaagcggtggtttagctgttcgtatgtggcacacaacgggttcccactgtgggcttctcgaaagcgattgactcgttcgtttactttgtggggatttggaagttgcatcattagaagcttcattttgtacattctgagatttatagtcttgatgtagtaatgcatggtgaggacaggattatcccgccagatcggggttgactcgaaaatggcatttatcactgtttgatcgtccaagagtctgtttggaaatggagatggcctatggcaatataatgatgtggggaaagagcagtgggtgtcgtctgattgacgttgctttctcctggatctgggtctgatatggagcatgactggggaatgggtggatccctggatgtgactgagaactttgtatttgagggtatggaagtttaatatgttatggctcaagtaaaagcgatcaagtcttctgtcagctccgtttggggcatggttggtcggtagactagctgcatgctgtgtagccttagatatggcgtctgcgcattctattctgttgaaaaaggatgatagactggggtcattctctggtagattccagtcgccacaaataattggggtttctagtgtgatgttcgagagtgttctaaggaagtaggacataaaagcttgtttagttattgtggtaagactagtgagtgaactttcgtgggtcattgcaggcacatatgtcaagagcaagtgtgggcaatggtcttcaaattgaaattggatgtcggtgacatactggttatatgggtggtcgaattggcgctggattgaattaacagtgatgatgttggctttaaaggcttcggatgtaaagagtttgactctagagggtagtggagctggaatttcatgaaggtccaggtcacttagaagagatgtgatctgatgtgaggtggtggattttgaatcatactctgtaagagctatgatatctggctccgttcgttgaatgtgattgagaaaaaaggtgaatttggaaagggttgagaccttctggatgttgtaaagtatgattttcggcatgattaattcatttcagaaatgttctgaagcaatgctgcttcggccgagttcagagggtgtgagtttgtctggcatctgggatcgttttcctgggggatgaatccttcatactcattgccagtgaatgatgtaggttcagggttccccaagtggctcagctcatgaacttctgatggctgataattgttccgatcgtccctttcatttcctgaatcatcttccatgtattgatccgaatcggtctcttcagtggtagatggtgcgtaatcattgtcgtctgagtccgtagttacgtccatatacatggatgtaagagtagtagcttggtttttggcccgcggcttttcactgttgggggaggaaggtgttggttgttcttgtgccttgcccatgaggtcttggtaaagtttgatccatttcggagtcacgcggccgtctgggaggtgtttggaagtgaagtcaatgtatgattctggaatgatcgctaagtgtttagcaatagttgcagaatcagcaagcgtgcaattcaccaagctgtgcattttgtcgttgccgcattgtagacagcctcgtttcaagggacattggcgatggtggtggctcaaagatttgcagtaagagcagaatttgagcggagagttgactctcgaggttgtctcaatccagttgtcatggaagagtaacctcttggagagtggggggacgcatggtgctgtgaggttcaggattacaaatgcgtctttgtattccttgatgtcaaaaagaccactcttcatggtttctgaaggttgccacattgttttgataacttccccatactctttgtagaggtcgttcgccagttcgcttagctgcttattatgaatgaaggctggcacagacagcttcattatgacagcgttttgcaacgcgttttccgtagggaaggaggttctggtgttgtggttagaggcagttaggtcgataagtgcttgaagtttagtagtaaggtttggattcaatgtgaccccagggtcattgatatggacgtagaaggatgttgggttgattttttcatagttgaattcaggttcgtcaaatgcggtgttgagttcagtatcgtttttgatggcattcttgataagattaatcagctccgggaagccaatttcagtgtcaggagatttgtgtaatttaaaggagaaaacgaaatttgctaaggtggtaaaaggtgtttgattggtgaaggagtcaacaatcacctcagggttgtggaataggtcgagttgtggtgggctttttttttgggattttgtggttttatgtgctttttttggggttttgtagtttttaagagcttgtgctaaggttatgttaccgacagatgtagcttgcgggtccaaaggagtgtcatgagtgacattatgaccagaattttggggttttgctggagtttggtgattttcgccgggtggcaaattctcttgatggggggaattttgcgtcggagagtgatggggagggcttgaagggcctcctggcggtgggtcacgatgtacagggtcctgtgggggcatgtctggttgcagcacctgtttgcagcacctgagtttcgcatatggtctcccactacactactcggtcagctctagactgtgtcaacttgcgcatgaagacacaagagaagagaaacgaacggcctcagacgtttacacgtaaaacgatcaggtgagctaagcccgatcacgctaagtaccaacagaacacccacctaactagggtctgtggcacctccacctgattcatccattgcgtcactggtgattgattcctcattgatgattgcctgttgccgagagagaagacgagaggtctacaggtctaccagaagaagaagaagtggtggccagcagacaggaccagaaggcgggggacccacccctacttgtactcgccagaagtggctgctttctcgcaaattgcctggcccgattaggcagtatccccctttcggatttggcggaccggtcgaaaattcgcaaagactccggcctagaagagtggccaatttgcagccatgtcaagctcctctggcttctggtctgcactgaggctgctacaggcccaccagcaaccaacatacactcgacaactatccatatggccatagaaaacattcactgcgaagtctagtggctgagaacgacctcctgcgtcgaaaactggccttaagtgtgcccaatttaggtggattagcaaaagtgcctctggagaactggaacttgtgtctcaatcctctgactatgttgatgcttcaccggctccactagctgaacacggtggtatgcttggcttggttgatttcctactccttgctgctgaaaagtccaccttaatgttgtcggacatttgggccaatcttcagaggtctcttgctgcttgggttttactcttcggctgctgttacttgcagatgcagaacaatgtgacgttccttatcggctgatgtgcttgccattgctgatttcaattgcattgactttcaaagtgccgttcaaaggtgctcacacaaactctactgtggggcaatttcaaaccgttgtcactggttcagttcaccaccagtttccaccaacactactggttcttactggatcgccaattctctattcgcatgttgctctgtctgcccgatcagcccagtcatcgtcaatatacaagcgtcacaatttctaccatagtaaatcttgcaactttgggcccagttttagggcccttcctctgccctcttccggctcagactttatactaccactatttaggacattctaaacatatctacaccactcgcagccaaatccagtcacaaacgtgattggtcaaaatgggtggcatctggcaaggcatttggtcagagattttggtcaaaaatcgcaaagacttttttactatgagcagtctgcttatgtagacgcctttcttctttgcaggttgccactgtgctctccacacacacaagcaacgctctccatgctcagtacatacttgtcttgcatgggttgaacacctctgcgacgcatagcctcgtcaactgaacactgggggcgaaaacagagcgccaagattttagcttactttactatggacagactttagcctgctctgaacgaacagtatcagcacatgacctcctcaactgatgtgaacttgatacaagtggccaatctgaatctgcctatactaatgtcattgacgatttccatttagttgctgcacaaatcactgttgaaaatcgcccatactaaatttactatggtggaactttgaagctgtttactggactcaattcaactccgcatcttctcaactactttgaatacactacaattccacaatctgaatccaatgacatgttggtcttcgccgatttcgttttacttgctgcacaaattgctgttgaaaatcgcccatactaattttaccatggtggaactttgaagctgtttgctggactcaattcaactccgcatcttctcaactactttgaatacactacagttatgcaatctgaatgcaacgatatatctgtcttcgccgattttactttggttagactttcagctgcatttggaaatcgcccatactaattttaccatggtggaactttgaagctgtttgctggtcttcgatcaactccgcatactatgaaccactaagactacactacagttatgcactctgaatccagtgatatattgtttgtctccgatttcgttttacttgctgcacaaattgctgttgaaaattgtccatactaattttactatggtggaactttgaagtggtctgctcatctcaaatcaactccgcattctctcaactactttgaatacactacagttacacaatctgaatccagtgacatattgtttgtgtccgatttccctctggttgctaccaaagttgttgttgaaaattgcccatactaattttactatggtgaaactttgaagttgtttgctggcctcaagtcaactctgcaacctctgaatgacaataatcacactacagttttacaatctgtaccgaatgatatacagtatgtcattgatttccatctcatcgtcattcaaattgctgttcaaactggcccatactaattttactatggagcaatttccaactgctgtcacaagctcagttcacctcgaacgttggccaatgaacatggcatctactgaaccagcgatgctctattctcccgttattctgttgggcatacattgctactggttgccactacagaagtgttacaatttgcgccatactaaatcttgcaactttggggcccattttcagggccttcttcctactttctttcgctcagacttttgattaccactatataagctatactaaacatatctagaccattgccaggcaactctgacttgaaatccatatcgcccaaccttgccgtccagatcgccaaaatcttcaccagaaattttagtgaggagaacttcgtgtaccttgacggccacggccagcactcatcctcttcttctgggatcaccacagtggcctgcacacagacaaccagcactctacacttgtcatacatccttgtcgggcctatcatgacccactcctccaaacccagcgactgactgtcctcctttcaagggcaatctgatctcgaacaaaaaacagccattgtcacaacttcaacctactctaactccatgatccttccacttattccaacaccacctatatcagactgatggggttgatgtgaccaaaagaacgatgtatgtgctggcgccaaagaagaagaaaagtttcacccactgcactgtctcatactgaacagcgaaactttgcagggccataactccacagccccttcacttgttttgacgctgcctttattgatcacaatagatccaccggctaaagcctatagtacaaagctggacaccgagatcgcagtgtgaacacttcttttagcggattgagaaattcctacttcaaatcttcaacctggcataacttcgtggtctcagctccaatcgccaaaccaacaacagatacatgattgccagcatgtacttgagtggtccatacaaagttaggctttcacatcttactgatgacaccacttgtcactctcgtcactttagtgcaagttgctgtatctcgccaaccgctggaccaatgccctaacggacttcagatacgccatcagtgcacagcgaagaactctcttgtatgcttactgttgttatacttagttcagaagcaacaagtgtaactaccggtcgtcctcgatatttgcaacttcaaggtcgcctttctctaccgtctgaagctcaattaccaagccaataacgttgtcgtgtttgtttcgtatcactctaacagaccataccaaacacagtaccaagaccttcagtatgaaagtttctactgtcactttggccagcactgccacttggtctcagtactatgtattatgtatatcagtctaactctcgtcaacaacctcctgcctctctgtctctgtcctttattcttcttctgtactacttccgcaaccactactgccactcctgctattctgcacgaactaaacaaccgtctggctgtgtaatctgtactgaactatattactggccacaacatctaccgagtcacgatctgcgcccatttcagctgcttctagcatgcccagcaacagcccaacccactggcacacactctactactactctcctactctttctctactgttctgtgcccctacttgcactctctgctgcctggctgctgtttcaatgttgctgctctataattcccccgtccaaaacgacaatccacctagtgtttcccgtccaacataaatattctgagccctcgccatacaaaacgaccgactttgtaaggacggcccaatctgccgtgtaatggcgaccgaaaaaaacggccgaactggcaaaaccgcaaaaaccaaatcgcggctccttacaaactgggccactctactatgcattcgcgctcatgacaatataaggtgttaccggctatctcgcctagctcaccgtcatactaaatatgccatactttgaaccgctattactggccaactttactgttctatccttccatgctagaccatttcgatacacttttgtaagctcttctcaaccacgaatgagccaaggttgaactccgacttgttgctactaccgaagttgaccagcttactgtggtcttgacttttgccgaatttcaaactggcattactctacaaccgttgtacctgtttctgtcaactcaactgatatcgatataaccgtctaccgtctagccattggtataagacttcatcatggacttctatcagaaataacttcatactgttagctgttgactccactataaaatttgtgtggggaaagttaagcgcaatcatgctgcctcagctgtagggcaattctctatcgtactctgtaattacattttatagcctcttatctactgttcactgttcctacgtgcccagaccagagtcctggcgcccataaccaaagcgtgaaatagcccactatgatgggcagctcgctgagaaaaagtgttgatctttttttgccactggatttgacggctgacttgacgggtacactcttctttgcagccacagctccttggccacatacacagtcacccagcactccacactccactaaactacttaatgacatgatacaaaggctaagcttaaaactcatgggctaactagctctttagtagggccccatccgtcaacagccatgatcgacacttgaaatcttcaacctggtatatctccaccactattaggtaaatgccattgccaattctaccgttacaatggctgatctctgaaggtcagtccagtaccaatggctctgacatcggggacataaagttgatcgccacaaccactgccatacaaaacagcaatatttcaacctagcgtatctcaacaacctaatcacatgaaagctgaacgagactaccaaacgcaatagatacacttactgacatgtcctcctgttagctggctgtcgatatcacgactggtcgtcacttattatcacttttagttttagttgtcgtcagctttgcatggcattatctcgtcaatggctggcccaaactccaaacagacttcagatacatcaccgctgcgataaggacacaaggtctggtgccagagagaagtccaaacatcccctacttactgcacatcatggtgcacaacggcgttttcttggaactgccatgggagacgaaacagtcgcactgtatacattaaacattacggaagacctttaccaggatcttccgagactctacgaacctgtatacaccatctataaaatctcctactatttctgctttgctgcgaggaagaagtgatgagagtggccttctcttatccctaatcttacaaacagagtacagtatttctaaccgaacgttagccttaacattcatcgctcgaaataataaacgttgatacaaaccaagagattcgcataacgtgaagttaacacgaggttaacaggtcgacatgaagtcaacggtggaggtcaacagaaagtcaacgggaggtcaacaaagtcaacgggaggtcaacaaagtcaacatgaatatcaacgaagtcggcatggaggacaacgaagtgatgatgaggtcagcataacacaaggtcagcgtaacgtcacttcttcatcaagaacaagaaccataaacacaataatagacttgatgaacggttagtataaggcccgtggaaacataagagtttatcagttgaaacatacctgtgatgtggttccaagatgttatctgttgatggtattagacaaaatgttcaagaatcgtcaatctcagtttggcaatggcacttgtgcctaaggcagggggaagaacccactgactcacacacgtggcttgaagaacgctaaaaaatccacccacctcgtgatgagatgagtggctttttggttgtgtggtaggttgtaaaattaatccgaacgctgttcggattaattttacaatctaccgagtacatttttcctagccttaattataagggagcccgcatcaaaatgcaatttgaagtcgtttattgagcggtgtaaccaccatcaacggtgaattctgagccagttgcaaatttggattcatcggatgccaagtaaacacagatccaggcaatatcgtcaggctcaccaatgtggcccattggggtcttggtccgagccgacattgcttcctcggccccttccagattatcaaccaatggcgtcttaatgtaccctgggtgaacgctgttaacccgaacgccatagtcctttaaggcgcagtcaacggcagctgacttggacataatccgaacagctcccttggtagcattgtaagcccctagcgttggatcacccacaaatccttcaattgaagacatattgataattgaggcgcccaaattcttgttcttcatccgttgaattcccagccgagtcccaaagaagaccccgtccaggttaacggcaaggactcttcgccattcttcagtggttgtattctcaacgctcttgctaacggcgatcccagcattattaacaaccgtcgtaaccgggccaaacgcctcttcagttttgccccaagtatcaacccaaccatcctcatcagatacatcttgacgcataaaccgaatcacgtccgggccgccaattgacttggccgctttttcaccaatatctgcgtgacgcccggtaatgaccacctttgccccttcatcaacgaatcggtgggcaactgccagtccaattcccagtgtgccgccggtgacaattgcaacctttccctttagacgattactcatagtgctagcctgctttcctaaaatttatttgcatgtgaattatatcactttatataattcaataaaagtggttctttttttaaaatctatttattgaaattaaagcaaatgaacacaattatgattggaaattttcaaactgattaagtaagtttaattgggtctagaatttttggtgttggaaagtatttccattccaaaaattttagacccaatggttccaccactaatcgtcaaggtatcgttcgcaatttgccaagtgacacctccgtcaagggtgccgctgttattgtcctctgcttggtcttgagtggcaatagttgtgatcggtgatgtttgggtcgtggaagtggggctggtggcagcaaaagctggcattagaacccctgtcaataataaaaatgaagcccccactgaagccgcttcaattattagtaattgattcaatttattcataaaaaacaactccctctagaaaaatagcttggttaccactcaaaaattcccccggattatcgagtgatcccttatcaaaggaatataacctctttttcgccatttatgtttggagaattgtccaaaatttttcggcattttttggagaaagctctaaaagagaataatcattaaaagcggccaccgccaaaggaatatatccctccctttggcagcagtcgctttgtttgaatcaatattagcgggatctaatcagttaatacccctccgttgtaaagtaccaacgaacgttgtccccactcttaagcttcgttaagtttgcagcatggtcaataaatttcttgttaacactgaacatccaaccggaaccggccttaacgtcattttccttgaggccgttaatgccgttcacgtaaacggaggggcccggaatataactaatcttcaggttcgtttgctttaaaatcgaaaacgcgttggcgccctttttaacgcgcatccgcttcgaatagaaaacttttttgtatccatcaaccgttaaatggatttgaattgtattcttagcattagacgactttttagccgcatgatgcgtatcctgaaccaccttggtttctgctttgtggttaattttacccagcttatcagatttaggggcatttgaccgcttagttttagcgaccttgttaggacttgcctttgcactggatccggttgtccgattagggcttgtgcttgattgagaactagcagtttggggtttgttggctgttttttgagcccgcctatctgcttttggttttgctttgcttgcaccctttgctttttgctggtgacttggctgtttaagatgacttgaactggtcgaacttgaacttgaagaaatcacttgtttagaagttgtcggcttaggggctgcgtctctcgatgaaatcacctgttgggcaccaaaagcgattccaattgtgagaatgaacgcaagaatgaagccaattgcttttttcatattgttttgtcacctctcactcaaaatttggcgattaattaatcgtgtaaactgaacgattctttaaagcagctttataagcggcaaccgctaaacttacctgaccgacaccatagagctgagtagctgcgtttttaattgaaccggatttattgacataggtcagcattgcataaagcggcgtcctagtttgacttgttttcatcgccgtgttattcacatatttcttcatgccaaaatcatttgatagggcaataattgcttcagcggttgaattggcatttggcgttgttttgccattaaacgtgtagccaaatgcaccactgggctgcacaataccagtaagaaatttttgccccttcagcaagctgtccttgacgttagttgtattaacctttcctcgagccagaccggttagaaccatgctggtcgtgtcggcatccctaactccttgttggttattatacgtccaaccgtgattatttaattgagctttcactagccgagcactcaagcttgctttgctaaacttcgctccctttggctgcttgaactttgagctcatcgaaatggcaatcagcacttgtgcctgggcacttatcgtttgtttggaaacacttgtccggtacaacttggttaccagattgattccctttttgtggccatatggcttataatctctagcgttgagccccatcgcctgaacggccatcacggcattggccattgttgcagcaggggttgtctttttgattaccaagttttttcgcagcaacgttttttccttggtattaaatttataaccgtttcccttgagccctaacagaaagtcagagtaccccgcagtcgcaccagtatcaggattgagtttcttactaaaaatagaactgctttgaccggaaagtccggtcttattttctttaatcatctttttggcataggaataagtacgggcaattctgctgtgaatggtgccggtactagccttcctaattgatgcagcgttggtagttgttgagagcgtcaaagcggcgataaccaaagttgcagaagtcaagactgattttatatatttattcataggtgtgatctccttagataatgcataaaagtggctggggcctcattttcccccaaccactttgatatttgattgttagatgaagaattacttattgtaggtcatcgaaattgaatcgccatctttcaaagtataaacacccatcgatgaaccaggttcggtgccattaactgaataaagccatccagtcattgtcccggctggcccagcattgtaaccattaattccggtaacgtatgcagtagcccccgatcctttacaagttaaaggcaatcttttttgctgggtaaattcctgcaaggcatcaaatgcgctggccccactgttaaccttgatactgccatttgcgatggtcgccccatcggcatgaatactaatagtggttgtgatggttttagcatcgtttgatggcgtaacaggatttgtgggtgccattggcaaagttggcgtggcactaggtgaattattagtagttgtggttgtccccgtcgttgccgtcggcttagagcttgtcgtcgttgtcgtagtcgctgttgaccctgagttagtcggtggggtactcgttgaggtccctgtggttgtggccgtaggtgtgcttggacgagtattttgggagctcttcttgatcttagtagccaagatgagcttcttgttagcagtgatgtagcggccatttgtaagttgcatccggttggaaagcccatagttaacaacttttctgacgcttaatgacgcattctttttaacgtggcgcttcttgctcgttaagttaaccttaccatactcgttgattcccttaggattgatgactttaatgcgggtcacctttgcggaatagtaggcgtgggcaaaatactttgaaccagaaagcgtataaccggttttgcctgaattcatgtcctttactcgatagatcgcatggccctgtttgttcgtttgctggctgataaccaggaacattgggcggttaatccgggcacgtttcttgtaggtcttcgtcagattcgatttagtaaagttcgaacttctatatagtttgacagttgtcagtgcatatacgatggaacgatgacttgcttttttaacaggcttcccggaaacagtcggcgtacttattggcacactactagatgaagaagtggatgttgctgatgatgaactcgatgcactggaagagctggccggattgttgacaaccgttacgttattgttcgtaacagttggtggcgttacgggcgttgctggtgcggcatgagaaacggttacatgattaaaagccgtaaccccagctgctcgatcggcgattgcagcactgctggttgaatcagcgcttaacttcgaaacatacgtcgctagtatttgatctaccaggttaagggcgtcactcttagcagcggccgttgcctgaggatcattgatgattgactgctttttggtaattgcggccgcctttatactgacaatctcaccaggtttcgccgcatccgcttgattgaaagcgaagatggatcctttaccaccatttctggtgaatcgggcctgttcaaatgtccaggttgcctgttgaatcagcattgcggaattcccagcggaaaccggggaaaccggatgttgatcgagagctctttgaacaggggcaacataatcagttttctcctttaatggtacataaacatttacgccggcagaggcaagggcattagtcattgttacatcattgtaggcattttcagcgccaaacattgtgttactactatcagcaaatccgccattttcttgataaagatgattacttaccgctttaactgccgtgtttaaagcatctgcagcccctggttgattcgtattcatcgataatgctaatattgcccgaccggtataatcaactttatcaaacccgttccacaaacctgttgtttgatcttgcatcccaattaacctcttggttaaagaagttcgggcagtttcgcttgcctgaccataactaccagtactcaaagcttgcaaatcattaacaattgaataatcactggcaggattatttgcatcctttacaatgtcagcaactaaattcttaccattcacattagttggatctttgccgattgccaccaaaccattgacggcagaaacatcagagatcccgtttaacccttgactgccaccactgagaaagtcgttattcttaagaattgatttgtaagcatattgagcctgcaaatcagtaatgccgttgtccccaaacactaaacatgtggcatcccaagcatcaatttgggacccttgttgcgcgatctccgttaacccagtggaaattgccgaattgacgtctgatgctgtatcagccctggatgaattaccaccactgaaaaatatcagaaaaatccctaatacaattgaaagccaatatagaaattgttttcttttcactactgaacgctccccaaaacaaatttaacggtcgttaaccgctattaatgctggactggttagactttctgcaacacaaaaaagcctagctagtaccctagctagagccatcttctatcattaataactaacgtccgacaattttgggcagactaatcccggaaagtttattattaattgacaaagtcgaccctaagaaactttgcaatcagtataataagcgtctcctgacttgatttcatccccaaatgtcttcttcccagctttagccagtgagttgcgacatttcagtcaatcttacagtagcgaaggggctgtaaaggcttttcacctttttccggttcattatactttttagcattaatcattatagcatggcgcgcgtttgaaatttttatcttgtaacataaatcattcttttttatatgatttattattactattttctaataattctttataattttttgatactttatttaaaaacatattaattctatcaaaatatctatatgttttattattaggtaaaaaataataaaattctatttttacttcatttaaattctcttttattactggtttacttattattatacttccaccactatttgatacttttacaccttttgattttaaatctactccatttattatattctctaataatcttattattaatttacttaatatacttttttgtatcatactatttttattattattataacttattaatttataatcatttatatgatttaatttctctaatttatttattcttgataataatctttttcttaataataatttctcttttattatttttgatatccttatatttattaattctaatactttagatatctctttttttattcaatctttatttattgtttcattttttattgaataaattactatatatttcattattttatttatcatttcttttttataccttttttacttctttatttttacgcttcccacgtaatcataaagtttattacagattgttcgtttattaatagaaagactcgaacttaacatttattgcatatgaggcaatcgttttaaccaattaaactatattaattttttattatacttttatatatatatatttattattattattatatatttatatcccccacccgtttttaactaagataagataagacttacttttttgggtaaatactgagacttgaactcagatcacatacgccacaagtattcattctaaccgattaaattatatttaccattacttactttatacccccacgggattatactatactacttttaggaaaaaccggacttgaaccgaatataaattgattaaaagtcaaacgttttaccatttaaactattttcccattcttatatatatatctatctatctatcttatatatattagaactttgaatcgaatagattcgaactattatttgcttgctccaaatgcaagtgacttacctattagtctacgactcatttttgtcattgataagacttgaacttatacgctttaaaaagcaatacattttaagtgtattgtgactaccaattccaccacaatgacttcccttatatatctataattcactactcattatatgcttagatgagaatcgaactcactttagttaatttgcaattaacttgttgaccttcaacactaaacatttttatattttattatatatatatatattattatatattatataatctattatttataaaatatataatatattcttttttttatcttatatatttaagatatatatatatatatatatatttatttatttatatatatttttttatttataattaattatacaaatataaatggatttaattatattactattgaatatattaaagcatttgatgataagtataatatattacttataaagtttggaactatacctaaaactaatgtaggtaaagctaagaagaataatataaaatgttctctatataataaatcataagttacatgtaaatatttagagaatgttcctgaagttaatttatttgttaatttcatttgataacatgctgataataatactgatgatgctgttaatactcctattactggattacttattatagctcctgttatacataagaattctcctataaagttataacttaatggtgtacctgtattactaaaactaaagaatactaagtatatagcaaataatggcataaattgagttaatccttgataatagaataatactctattatgatatctatcatataatactcctcccattaatataaataatgctggtgatacaaatccatgtgctaaacataatactaatgatcctattatacctaataaattatttgcaaatattcctaatatacatactcctaaatgacttattgaactataagctattattacttttaaatctgtttgacttaatgttactaaactactatatattattgttattattcctattacatataatattggtgcatataataatgatatttctgatatatttgataataatattcttattattccatatattgctaattttaatactattcctgctaataatattgatcctcctaatggtgattctgaatgtactgttggtaatcatgtatgtactggtactaatggtgtttttactcctaatcctatcattaatcctattaataatacactttgtaattctattgatattattttactatttattgttacataatctacattgttatatattacatatattaatactattgataataacataaataatgaactacataaagtatatattaatacataataagctgctttatttttatttgatcctccatatattcctataattaaatataatggtattaatgtactttcaaataatacatagaaacttattaaatctaaacatacaaaatttaatcccattaatattactaataacattattaatatcatatatgttccacgtttatttattatattttctcaatttgatattatacttattactcctaaatatattgttaatattaaaaatattaatcctattccatcataacctaaatctatatttaatatatttactactcttaagtatccataatcatttatatttatactatttaattcatttattactatatataaacttaatatacataataataatatccctttacttatcatatttttattcgcttttattgataatattttattctttgttaataacattatacttgataatcctacaaaatttaataatactaaatttaacattccttttcctttctttttatatcatatatcttcattatatatatcatatattcttctctttttctttttattactcccactcacgggctatttacctaatatcctattggagttgaaccaatatatttaaatccgtagtttactattttaccattaaattaaggataattttcggaaattgtaggaatcgaacccacacagaatttcttcaattatatagcaaataacacatcttaccaatgattaaatttccatatccttattatatatttatttaacttcttcgattctgacctgactcgaacaggcaaccctcattgtgacaaaatgatacttaaaccaattaagctacagaaccttattctttatttatgtaccccaagattggacctattatatatatggagttatcaggaattgaacctaaatatattgcttgcaaagcaatcgttctaccaattaaactataaccccttaatattttattaatatatattattatataatatatatattattattattattattattattattaatatatatatatatatatatatatttcaatttaataaattaaacgattaatgataatccatttcctgcaaataataaacaaggaatgaatatacagaaagcaaataataaaggtaataaaacatatcaacagaataagattaataaatcaaatcttaatcttgggaaagaagctctaactcatatatatgtaaataagaagaaattagttttcattataaataaaccactaaatattaaaccttctataaatcaatataaattattttgaggtaataaatctaagaataatatactatttatatctaaaggtcatgataaataacctccaaagaagaatgttactgttaatactgacataaataccattgatgtatattcacttaaaaagaatataacaaacggtgaggctgataattctgtcatatgtcctgatactaattctgattcagcttctatattatcaaatggtggtcttgctgtttctgctaatgccgctataaagtatattatacataatggtagtaatgggattatataatttatatatacttgattttctattattaattctatatttaatgaatttactaataataccattataaatactattgttgttaatattaattcataacttattaattgagctgttgtacgaactgatgctaatattgtatatttactatttgacattcatcctactattactgtacctaatactcctaatgatcctgctcctaataagaatattaatgaatattccccttctaatatacttattcctgtatttaatggtattaaaccaaaacttattaatactgcatataatgttattaatggacctcctatcatatatatatattctccattatgtactaatactatctcttttactaataattttaatgcatccgctattgccattaatactccatagtatcctaccgcatttggtcctaatcttctttgcatatatgccatcgtttttctttccgctactgttaaataagctactcctaataataatcctactataaatattatagccattaataaatattctattgattctaatatctctattagtatgtacatctcttatataattactttttttttaattattttaccttatatttatatatatatataaatattcagaaaattattattcctttttttatttaattatttcttaaataaatattttattttatgccccacacgggactttttttattatatttttatattatattatattatacattttttttttctgattttattactactattattcctattatacctaataataatattaaagctattaatattaatattaatgaatattctgtaaatattaaactacctattgttgttaaatctgaattattatgtatatttaataaattataattttcatatatatttactgtatttaaatcacaatcatttgaatcattataatctaaatcatctaagaataatattaataatattacaaataaactactatattgaggttcgtattcttcttttttatttaatactgaaagtataaatacaaataatactactactgctcctacatatattaatgtatataatatcccaaataattgtgaactattaaatcataattctgttattactggtattattgtacctactaatatccctaatgattcaaatgatgttgtacttattaatatgtaataacctattaatgttacatctaatatactaaaatctataaacatttctttatctctttatttttatttttaattattattattattataattatttcgatatatatatatataaatatatatatatatataagaatatatatgtgactttttaattaatctttttaggttatttacacttaacttttatcttctctattaattctttatttattgagaagagtgtgaattgaacacacgaggataaatatcactgagtttacagttcagcttcaactaccagcattgaaaatcttccccatatatattctaacggattaagtaggacttgaacccacactactttttaagtaataatatttcaaatattacgcaataaccaattctgccatcaatccatagtctaaatcaggacttgaacctaaatcaaatatattaacagtataccgctttaccaattaagctattcagacttctttattattattattatataatatattatatattattatttatatctcatactttttttttatctgtctcatatctaataaataaattccagcaggacctttttttatgattgataggacttgaacctataattatttaggcctaaactaaacacgtataccaatttcgtcacaatcacttatttttatattcatttataattatttattattatatatatatatatttatatatatattagaattatttaattagaatatttaactatttaattctttaaataatctaaatcatttaaaacatctaaaatttcctctaaaattattaattcttgtggattatttatattgatattcttttttaatttaaagtataattctctacatttttaatttttcttattctattttaatattataaccctaatataaagtaaactaaatttatttacatcttagtatataaattagttgataatataaatgaaattactttataaaataatacatcattattacttaatagtaaattaaatattatattaattctttcactttcggttcttctctttggttttaacttaatgttcgctgaaattgatcgtccgcaattaatcacgcgaacttttgatcgcacctacatcgtaaagtacctcggacttgatgcgttcacagtttacgatggtgccaaaacggaacaaacgagcaaaatgcgttccagtgcaactaagagcgaacttaaaaccgttaaaaaatatgtccgtagtcattatgcaaaatccaataaaaaatattatggcatcgccaaaggtaaaaatgtcattgtcattcatttagaaagttttcaacaatttttgattgatgacaaggttgaaggtcaaactgtcacaccgtttttgaataaaatttatcacagcaagagcacctactcattttcgaatttctttaatcaagttggtcaaggaaaaaccagtgatgccgaaaacatgctcgaaaccggcacgtttgggctgtctcaaggctccttgtttgcccggcttggtaccgatcaaactttccaagcggctccagccattttaaaacaagaacaaggctattcttcagctgttttccatggtaatgtagccagtttctggaatcgtaacaacgtttataagaatatgggttatcagtacttcttctccgctagttattttgatacgtcaggtgataaatcgaccggttatggcttaaaggataagttactctttaaggattccattaaatacttgcagtacttgcaacagccgttttacgctaaatatattacagtttccaaccattttccgttttacttagataaagaagattccagttttaaagttccagacacaggcaatacttctgtaaataactatttcagaacggcaaattatcttgatcaatctgtcaaagagttcttcactttcttaaagaagtcaggcctttatgataactctgtaattattttatatggcgatcattacgggatttctaactcagcaaataagaatttagccaagacctttagtcaagattccagtcacttcaagtcatacggcagcgaccccgtcgataattggacggattgggataatactcagttgcagcgtgtacctttcatgattcatgtccctggtgtcaaaaatggtggcattaacaaagagtacgcgggcgaaattgatgttcttccaactcttttgcatcttcttgggatcaactccaagaaatacatgttatttggaacggaccttttctcatcacaacacgatcaagtggttgcttttagaaatcaggatttcattacaccaaactgcacctcgatcagcgggactatttacgataacagtaccggccagattgtgacgccgaataagactttgaaaaagcaaattgcaaaggatcagaaaaaagttaacaagcaacttagtatgtctgactcgttaaacgagaaaaatttgttacgattctacacacctaagggctttaaagctgttaattcacagctttacaactatgcaaatgggcttcaaaaagaacttaagattcaaaagaaacttggtctgaagtcgacctcaatgtactctaaaaaccgtgatcgttctttagaggatttgtataaaactgatgcgccagaagcaacccactctaagtctaagaataatcgaatccaaattaccaacccagattctaattctgatgactaacaaagacgcgacaaacgatagttaagctaactgaatcaactaaactaaaaacgagccccaaccaaaacatatgttttggttggggctcgttttttactctttaaagttccatcgacgtactatgcaatgggccacgacggtcgggatacaattccttcatgatagcactaactgccattggtccctcagcaaacgcggtcgcaattaaatcaagtttaccttcataatcaacgccatcaccaattgcataaattaacggaagattcgttttcatttgacgatccaccgtaaacattcggtggtgttgttcaggctgaatttgccattgcttaattgttttattgtttgaaataaaaccatagttaacgatcacatcatcaacttctttttgtaaaagacgctcccccttcacttctttcattgtcagtaaaaggtgctcatttgtttgttcaatttcctttattaaaaatggagttaatagttcaacctcagatttttcaagtaattcaacgctgtgttccatcccccgaaactgatttcgccggtgcattaaatacacatgtttagccgtttcttgcaacattaaggcagtatcaatcgctgaatcacctccgccagctatcaaaactgttttatcttgaaaacgacgcggatccgagattgtgtaaaaaatatgctgatcttctaattcttgagcaccctcaactgccaagcgacgcggactaaacgccccaactccggtagcaataatgatggcttttgactcataagttccgcggttagtcactactttatagccatcttcttgttggataaggtcagtaaccgtttcttttaaccgcacatcaacaggtaattggcttaattgtttatgcaatttctcaattaattcatttgctttgacccctgtaaaacccgccacatcatgaatatatttttctggataaagcgcacttacttgccctccaagttgggataggctttcaataatttgcaccttggctgttctcaagccactgtaaaagctcgcaaacattcctgcagggccaccaccaataattgtaatgtcataaatgtcagacacgttttatccttctttctttacgtaagataactgttcaattttaacacgattttcagtcagtgttgatttttaaatttgtcactcaaaaagacaaatttaaattgtatttagattcgttatttcgtatgattatggtgtaccaacaataaaatttgggaggctcctcatggcgacacgcaaaatgatcttagatttagatactggtattgatgacgcaatggccattgcatacgcagtagctgctccagatgttgatttgattggaattgtttcttcatatggaaatgtgttaactccattgtcagcccaaaacagtttgaaaattcttgaactacttggtcaacaggatgtccccgtcttccttggggaatcacactcttccacaaccactcaatttgaggtgatgccgatcagtgtacaaatccatggtaaaaatggaatcggtgaagtttcactccccaccgccaaacggcaaccagaaactaaatctggcgtggattttttaattgaatctgcccatacctatggcaaagatctgatcgtagttcccactggtcctttgactaatttagcaaaggcattgaaacaagccccagaaatccaaaacgaaattggtaatgtgaccttaatgggtggcgcactaaccgttccaggaaatgtgtcaccagtagcagaagccaatataaatcaagatccaactgctgctgaccaagtttttgaaagcaacttgaacatcacgatggttggcctcgatgtcactttacgaacccttttaactaaaaatgaaaccgcgcaatggcgcaaattaaacactgttgccggagaaaagttcgcagatattgtggattattacattgatgtttataaaattaccagtcctcatctccatggctgtgcccttcatgatcctctggcagttggagtcgctttggatccaagtttagtttcaacacttgatatcaatatgtttgtggatacaactaaagaaatgtggggtcgaaccattggtgatccagctcgattaaccgatcaacaccctaatgtatctgtcgctttaacggtcaatcaagacacctatctcaaacggttcatgacatacctttccgaacttttttctcaaaattaataaaattagggataaccagagttgcaatcataatttgattgcaactcttttcagtccttaacaacctgtttcaagacttaccagtcaaatatttaccaacccatatggtaaactagattcagataacttttgggagtgaaccacatggaaatcgtcgttttagttttagttcttgtgattgcggtactaatttcaaatattattgccagcaaactcacacaagttccccttgcctttattgaaattgcaatcggcctgcttgtggcatttgttgtgccttattatcgtcaccacacaatgaatccggatctctttatgctcgtcgttttagcaccactaatgttttatgatggcctgaacactaacatgcgtgctctgcgacgttctttttccaccacactgtcacttgccattggtcttgctttagtgaccatcagtatcgtcggcgttgtcactcacttaacattaactgaattggcactgcccctatcttttgcgttagcagccatcatcacaccaaccgatgctgtcgctgtttcttcagttaccgccaacattgaaatgccagaagaggccatgcaaactttaaaaaatgagtcacttttcaatgatgcttctggaatcgtaatttttgatttagctttgcaggcttttacaacgggaaaattttcgtttacttttggtttttttgatttttcatatgtttttttaggtggtttactgttaggtatgattttgggaagtttattggtctccctgagaacttttttaatcagtcaccgaatggataattcttccgtcatcgtcaccttaggaattttgacgccatttttcgtctattttgttgcggaattagcacatgtctccggaatcttagctgtagtggctgcaggacttgttcacggcgtccaagaagggcgtctacggcttacttcaaccaagatacaggttgtcagcaacaccacctgggaagtcctctcagacaatttgaacggatttgtgtttgtgctgttgggcgtgtctttaccaaccgttattgccgacatttcttatcggaacaatagctttctgctatttttgatgggattaagcatcttgctttatgctttaatgaccattttgcgatatttatggttgcgaatggggtttgccactattcgtgtccgcccggaatataaaaacacaaattgctggatcattgcgttaagtggtattcatggaacaattacgttagcactggccttttcattgcctttgacgctgcatggcacggtctttccttacagaaatgatcttttatttattgccagcattgtgatcattttaagtatgttagttccttctttaattttaccagctttgcttcctcgtcaaaaagaaccctttttatgggaagacgccaattctgcacgcagaaaaatgattaattatgcgattcaaaaaataaccgaattaaacgaagatcccttggaaactcaagctgttatttcgactttgcatagtcaaaataagccagaaaaaatcgaaaacagaaggattttaagacaattatttgcccagactcgtgatgttgaaaatgatgttctagacgaaatggtggcaaatgaagacatcacagaaaaagaacgccgcctctatcaacgcaccatgttgacccgagatgcccattctgataatagtgttttgaaaagcatttggcgtcaaattgcttaccggttcatctatttttttaaacgattaacgcatagcagaaaaatcaaaatagcccaacaacaaatgaaacataaccctaaattaatgaagaagtttaagagtaaacatgacacaatcgtcgaaatagaaaatcgtgcaactcaagaagtgtttaaatatttaaaaagtcctaaggtaaataaagaaagtcgcacggatatctcgatcgtccaacggtattaccgcgaacgtcatcgtcgctatcaaaataattcaaacagtaatgaaatccaagaagaactgtttattaaggcatttcagtttgaatataattatgttcaaaaccaacttactgaaaataaacttacccgtgagcttgcatcagctctgtacgaacaaatttcaaatgacgaactgatttatatgcaaaatgatgaaatttatgattaaaactgaaagctgaaagtatcaaaactacttcaataactgatgttaaacgattcagtctctaaaaaaatagtttaactgccgtcctgcgtctcacttaatctggaagcaaatgggctcagtagtgtcgtttatcttagcgggtttcgcttagataaaagccgagcttggggaagtggcttgtggctccaagctcgacagtctcattagtaagacctgtcgtgtcctgattcgcttcgtcgcgatttggtagcttttctgagatatctctctcctccaggtctgagattttctctattgtatcaccgttctttgctggagcgaaattgatgaacatcatgtcctgcatctgaggcacatgtcttggttcttcagaaacaccaccttggtcccggtctataaccgcaggagcaattggttctctatgatcaattcccaaagcaacgagatcacaatctttgtatactttcgttggtactatgtaagtgacattggtcgtttgtatcacttcttcggatatagaaccatcactctctcttttcattacgaccactagatctccgtctaatactgtggggtaattagtgcatggtttgaaagcaggacccagatagaaacacacatgtgatttcaattcattatctggtcttttggatgcaacatcatagtatatgcccagcgacccaaaaggtctgaacacatgcttcatgatctctttgcattgattagcagtaaaaacatagtcaagtatcttagtctctggggaaacaccgtctgaagcggccttgtttctcaatgcgacagaatagtccattgcttgtgcccagtacttttgatctaacccggatgatgctaggttcgtcctaatatcgtccctaatggttctgtttctcctttcagccttaccattttccatagaagcgtaaccagacgtagtcgtatgcgtgattccttcctcactgaagtaatcctggcattgcttattgacgtactctgtacctttatcggtatggaaatgaacgatgggagaattaaacattctcttaaaccactcgttggctctcttaatgtaagggaaagcgtcactcttcttccgtagaacgaaggcaagacaaaaattagaatattcacatataatagtcaagacgtagcttgtttcagtatacactgagctatgacccctatacattctattggcaccgtactcattgacgtgcatcaagtcactacagactcggtagaaaggagaactgataagatacttatctctagatcctttaacatgatcttttctcttagctttgcccatcttgcatgctaagcatgaattcgagctttcatcttctggtccatactcttcactagtagacacgaaaccaccctccacagattttatagccttccgcttatcaatgtggccgagtgctgaatgcaaactacacacttgtagctcattcggtttcataacaaactcttttggtattaagatgaatctatcaactcgtttgacttcaacgcagttataatcatcccagaacaaataaggaacacctctaattgatctgtaatcaataccagcggacgttaattcatattcactaataaaagttccattgatcttattacaatggtaagtaagaatcaagacttctttgctgatttcgttcgatgttagacacaaagctaggtaaccataaccaaagacttctatcttagaaccatcgacaccgataataccattggactcactttctgacagagctttgtaatctgaaagcatatcacctctgcttgtcacagagatttgagcacctgtgtctagaacatataggtaatcacgctcagtcgtgatgcctcgccgcagtctctttcaacttggcgctttgctcggctgcaaaaacctttgccacctgtgcggcgatcgcagcaatcgtagctggaccaggttcttggttgtctctgtgaggtctgtcagactggggtcttctcctaccattatatccatcacgagtattagaacgtctgctctctctaccgtgagatctgtctggtttgtgggaggtatcgttgtctttgctaggggtgttcttcttgcagaatttccaattatggttatcactgccacagccccaacaacctttttcatgtctcaatctgcagttctcgactggatgatatgagctatgacacaagttacatgttcttggtagtctccgtctaacgtctctaccatcggagccttgatcctctctaggtctccgtagctgcctgtcacgagtcactgcagcaactctaggagtgccaggagtgtgaccagggtttgtcgctgcagcaacctcgttgccagcgtaacggtcattgttgttcttccaagtgtagaacaagttgattgctttaatgacaccttcatccttatgcttgatgagatcattcttaagctcactgtctttgataacagtgtacacataggtaatgaaccgatcaatgatttcagtctcacctgccttagtgcccatgaagtcgtgtctcattgataacaacttccactccttcaacatctgctgcttcgttttgttgtcgtccaggttgaagtcgttggtcatcttttgcaagacggttgcactgaccttcatacctgcaatgctaactgcttcaagtaaccattcttgtgctggaagcaaagacttcatgtcgtaagccatatcgtcaactgagtcgttgatcaacttcttgacgatgtattcttcttcaggtctacccttgataacagatgaaccaggtttggttgcattctgcaataggatagtgcagatgtcattgagaccgcagaatctggtacagtcattcatccagtcccaccactttgaaaagtcattagctgagtgtaacatgactgttttgaagttgtctctcttgtagagtttgttgtagtgtttagtgactgggtctgtgtcaggatcggaatagaaagtaataacctcttcgtgttttgattcctcatccttgttcgcatcagttttcttgactggcttcagatttgcgactgcgtcttggaggtcttttggtttatcaacctcttcttcacatagatcgatttgaatcttctccttctcggtagtcttggttgaagattcgatgttgacatcatcatctttcttggaagtcgattcttgtggggattctctaacggtttcaggagttgtctcctcgtttgcgttagcgacagtgtcagtcttctctgatgactgctctgagtgcgagcaccatattaggatttggagaagttgactttgtcgcgtctgcggattcgttaatattggacattgtgttatagtagtcttggtttagtatatgcttatataaactgttgttaaatgatacaagcttggtctcgcaagtcttccaggagattccctgggaacagtacttgcttccccatcgtccttctatgggtgcggaatgatctgctcttttatagtcttatgatcatcagagcattacatcagggcttatatcagattcccctctgtaacagctactggcgtactcagtaatcacgttactgtgctcgtataccaagtctctgcttcggcgatactgtcttacaccggtatggactgatcctctggatcatccaatcatattgccgatgctgcctcgtgtctagtatatttccataataactaccacgttcagcacgtatccggagtatcactcaacggatcgtccgaccttcagtcggcggcaccactagttatttccttggtcacaccatcactggtgacacgtttatcggaaactgccaggtgatcggtatgcaccgtggaatggttaaactgtattgacggagtttccttccgtgtacgactccgatactcatccgtatcgacgcgtctacctaccgttgggaatcgtggatatcataccttaacacaccacctaatgcgaacgattatcataacatatgataggacagtataagactttctcagatataaagtcatatgtaaattcaattaaataagctaaaacaaaatcaaatttcgtcagcgtgaagcattgtccttaatcattattgattgcaatctaggtaacttaagtgtgaagatgaacatcgccatgcttgtatgacaacaagtctcatgtgatttcatttatccattccgagtaatcatgtgcgttgcagttaaacatttccaactcaactttgatctactccggtagtctgtcagagctccatgctccatgaccagctagtgttgtttcagtgatgaacatcagattcgctaatttccataatcttgggaacgagtttattcatgacttcagtagaaactgctttggttaatatgtctgctaacatatccttagtactcaagtaaacgaagatgatatgttcgtttaatttgatgtcgtttgctcttgcaacacgcacacccatatgctttgtacggctaccgatcgtacctttattagcgagcataatcgctgatgtgttatcaacatacatgacaagaggttcgaggtttgcttttgcaccaccttccttagtagtctctctcttcgtcatcttattcttacgggaatactcaggaccgattattctcaagaatgtcaggaattcacgatagtaagccaggttattacctgcttctaccattgccgccacctcggcatctgtcgaagaagtcgctgcatatcttgcaactcttgcgtaccaagtgattggtccaccattcatcataaagatagctgctagggttgatttcctcgtgggtaagtcacccgcatggtcagcatctgaataggtgatcagcctactgatagctgtgcccttatctgacacgcacttggaatacctaatcatatatcccctcgtgtggtacgtgtaacgtagtattctcgttagctgttgtatgataatcgggtgtggagttgtcacgaaccttgacatgtaattggctgcgtaagcgagatcgggtcttaatgccgctgctatgtactgtagagcgccgaccacctctctgcaccaagtaatcgcatgtgcaagttcaccacctgtcatctgatgcggggtagcagtcaccggattaaactggaatcctggttctaatggcgtcttcaactttctagaattcttaaattctttagtaagacccatgtcattaattaacgttttaatgtagctgcttagacttagatcaatgtgaacaagttcaccagatctcttgtctcttttctccctaagcttgatcccgagaatgtctctaaaaccattctgatcaactttagtctgcttgagctcatactccgtcttaagttgttccacgaacgcttcagcaatatcttttgtttttccggcaataatcatatcgtccacaaagaatgctacaacaagtaggacttctttcgtgactttatcggttttgattagaacacatggtatatccccccttaattcaaagccgattgaaagtaaccagtctttaagggtttcgaaccattgtctgccggattgcctaaggccataaactgccttcttaagcctatgcaccaccctctctttaggggacagatctgttggtttgctctccatactctttggaagctcaacatagatctctgtgtctatcggtgcattgagatatgctgtcttaatatcaatcattatgatatgacggttgctctggactgcatcagcgattatcattctaagagaatcgtaccccaacgtagggctaaacgtatcagaatatgtagatggatgctgcttatcacctcgtaagacaacacgaactttctttggtttcacaccattcagttcacgtttctccgtacatacgacttgcatttgcacagtcttcttaagtatctcggagtctgaagtgcgaatgggagtctcatcccagctgccatttaatctatgggattcacattcagtgtcataagccagcttccaaccttggccttcttctttatcaagcttcacgatatcatagataagacgttgaggagccggcttttctcccggtaatctttgcagatccatcatcctcacagcactaacttggttaaggcggtacatgcttcgagtaattctcctgtcctcagggaacgttgtttcagcattaccttcgtgcgggccaactggctggtcgtccttatctagctcctcattgagcatcgtggcattagaaacatccaataggtcatgaaaatcaccttcttccaaggtgtgtacgtactctccatgaaagctgttggtgttggtgttggtggcattttcctcctgttctttctctaacagaggaccgtcctcagcatcctcgatactgacctcggtgttgcgcgtttcgtttgtagtgtgatcacttgcatcatcggcattctcctcgatgagttctttaaattggcaaaataaccagaatgactatgcaccctttttagattattttctgggtgttatcttgcaagcatatcgcaatcttaatgatcggctcaatctggtacaagacaaaccagtgtcggcaacggatttaattcttacaacattaacgcaagaattaaaacccttgtctagaagtgagctcacggccctgatcccgcaatacagcgatataacaattaaacgagctcttagtgaattgaagaaaagtcagcggataaaacttattggcaagggaagatcgtcaaaatatattttgaaaaattaagatgtttagcgctaattagttctctatattataagtgaagagaacaatttatccattcttagttacagaaagaagtcttttggtgactcatgatgtagtatcacgatgattagttataggaaatggatttgatttgaaatctaagtttaaagattacattagcaacaaaaatgatatgctttaaagaataaatacattgatataggagattttaatgaaaagtatttgggagatggacgcaccaataggcttggtttttttctttgggccagctttaattattggaattatgatgttaataagtggttttaacaccgtttcaaccattatggtcttagtgttagttttgtgtgggcttaaatacatgcacacttcaataattggtaagtatagaataatgaaatccattgttaacagtattcatttaaaaaaagacagtaaaatattagacgctggctgtggtcacggtgcctttatgttgcaatttaacagacaagcagcaaatataagcgaaataataggaattgatatctggagtaataaggatcagggaagcaattcaattgcagctactcaaaaaataatggaaaatagtaatttggctgacaaggtaaagttgaaaactgctaatatcttaaacatgccattcaacgataatgaatttgatctgattgtatctagtttggtactgcataatattaagccatttgagaaacggaaagcagcgcttgtaaacatagcaagggttcaaaaacaaaaaggtcagttagtaatcatggatataggctacgaaactagtaaatatgtgcgtattcttaaagacttgggatatcaaaacgttaatattgcaaatactggctataacggttggtggggtaccccgatggttccaacttttgtaataacagcaaccaaataaaaaagctactaaccaaaatcgatttgatccagcatggtttcttgactagcttgatccaatcctaaacaagctaaagtcatcgtttcgctagaatgatttaacaggttcatgactaggccaatattataattcgattgtgtatagacgcgatatgccccggttttacgcatggtatgagtccctagataattagtccctaataaatcggcaaccttactcatgattttatagaactgtttttccgtgatatggcgctctgggtgctggagggaaggaaacaaccagtcagagattaaatgattttcctgcagccaagcttgatagactaataagtcattttgagcaggtttcaagtatagtaagttagctttgccgattttttggtcgtggataaacgcattctgacgcacgctaccattttcgttaaagacatcggtccaacgaagcctcataacatcgctcacccgtaacaaggttgctttaccaacttgaaaaatcgtatagttatggcgcccagctttgaaattattaaataaggtgtcttgcacctctttgagaacatttgaatctttgtatgactgtgtgattaatcagcagtcgcaaccttagcagttcgacgcctaactcgaagacattcagcagtaaagacttcttcagtagtgcgatagttcagcttacatccacacctgaatatcaattattcattaagttactaaagtctgatcatgatgttgactctctttttaaaaaaattaaggttcgctatcctaactttgataaaaatcagtttataaaaaacatagatttgctgcgtaaagatggcatattaagtataaagaccgaccttcctactgatataacaacacaggatgttcagcgctaccaacgtcaagtgcaattctttagcgacttagctccagaaacaatagatccttggcaatatcaaagtaaattaaagaaatcatcagttcttattattggcttaggtggaattggaagctggatagcccaatcgctagcaatgattggtgtgggaaaattggtattatgtgactttgatacagtctctgtacacaatcttactaggcaaaccatgtacaatatgaatgatataggtacatataagagtgaggccctttctaaacatcttaaacaaaacaatacagaaataagaattaaaaagattagattcaaaatggagaacgaaaaagatctattaatgttaaaatccgaaataatacagactgatttagtaattaactgtgcagattttcctgatattaacactacttctagatgggtatcaagcttatgcatgaagcttaacaagcctcatatcataggtggaggatatactggccatataggtctgattggtccgaccattatccccttccaaggagcttgttggaattgttttgaacgaaaatacaagaatgatttaaaagatcatcactttgacattcttctgaatacccgaaaaagctctggagctgttgtctttttatcaagtataattgctaatattcaggcatgggatggtgtcagagtcataacaggaattggctcccctttaatgttgaatcgtaagggttttcttgacctagacacattaaaaattgactgggaaatagtttctaaggatcctaattgcgaggtttgccaaaccaattcttatgataagaacaattaattgtaaatcgttttaatcaactcagtgtaataatcctcgtattagaatattgaaagattgaagggccagatttgaaaattataagtgataagaacaacaatatcatcaccaatagagaatcaaacattcaaatcagcaaggattttcttagtaattttatcagctctttaagcggtaagatgttttcttttggtttaggtttaatgctacttgaccaaacaaggtcagcattaagctttggaatgaatatgttaatttctccaataattggtctattatttcttgttcctattggaaatattgttgatatggtcaaccacaaaaaaattttaatctatagtatgtctttaagaatgtgtgctttgttagtatttgcctttaccataaatagatttccaggagcatacaagctaattccagtgcttctatttttaatcatcgattccatatctgtaaatttttccgatgtctgctatagcgcttctattcacgaacttgtaaacacaaatagaatacagaagctaagctccttaacccaaacagcaacttcaatttcatctattctgtctccaacattaggaattggcttgtatagtgctttaggatttaagggattcatattaatagaaatctccgcgtctatattatcatttttaatcatgttaacgatgaaatttcactatcagaaaacaagacttacaatcaaagattataatgaacatggtagtaactcacccttaaagacttttaaaatgggattgtcatatataaataaacgtgcactgattaagtatattattataattagcgttatgctgaatttcttttatacggcgcttaacataggtcctccgttcattataaagaatcaattgcatggcggaaatactcctataggaatgcttgaaacaggtagtgcaatcggtatgctactaggtagcctgctaatgaattttttgccgaacactaataaaaaacgatttgctttcaaaatgtttattcccttttttatactcgatatacaatttattttacttggattactgttcttatctactagtaatgctctctttgtctcactatttggtagcttgataatgggattagtttctttcagtttggcagttttaaatataatagtacaggttcgcttgcagaaaactgtaccaacagaactcttaggccgtgtgatagctacattaacaactgcaaacacatccattatgccactcggtattttgatcttttcttttttatttcaaaataccgagtcgggtggaagtatttttatttttagtgggctaacacttcttttatatactttaatttttttcaaatcaatccgacatgctataagaaatgacaataaattgtaaacacaactacaaacttccagaacactataggtcagtaattgatttgccagtatctcattcaattattataatcaaaaatggctcataccaacgtaatttctttcacgttggtatgggccgttagattatttcatcaggtcatcaaacatttgattaaccgtctcttgatcacgattgttcgtaaattccttaactggttgtaagtcacttaaatcattggcaacttccttcgtcgcataaatcatcactggcgtgcgcttcgcaaactgggtttggactaacgccacattaccaactaccggggtgcccttcgtcttttcggtaatccgccacttatacaactttttggtgtttaaaacatgttttgcccgcgcatcaggatcatgcacaatatgataggccattaacacattatcagccatgttgattcctcccattattagccagtagttattccttaacaccattagtatacgtgctgagccctcaaactagcaattatttgaaccaagccaccaatcgatcaaaccaagtttggtgatgaccagtctgggccatcttaactactttagtaaccgttggcttaggcgctggagtcgttgttttggccggggttaccggcttatcggtatgatacttaaccgtactggtcttatctttaccattagacgcttggttattccaagtataggtctggccttgcttggtcaactcactatcagctttgtcagttggaagactggcgacaaagcgtgttttggtttgcttaccagcatactcagcgattttatcagcttttggcgtcacggtcagcttaccgttctcaagtttgactgtgaaattagcggtcacatctttagtgtaagtcaatgtcgctagtttttccttagtcattgttttagcatcaatcttgctagtctttgatgttgactgatcatcagttttagctgacgaactagcgctcattgcggttgaggattggtcatcagtcggcgaattgtcaaactaagtgcaacggtttgtcaaaaaatacttcatatggggtttcatagttggtagattgtaaaattaatccgaacagcgttcggattaattttacaatctaccgaaacataatgagcatctattagataaatcgtatttcgaaaaagtcgctgcactttttaataagggacagtctgatcccctgctaggtgaggccatgtgaacatggaatgatcttcaggaaggtgtcacagccaatgagcgccttccagacacgctcgttgatattgctgtttggcccgtttttaatcgcgctcctcagctatatcgacaagcaccacaaataaaaacccgccctgcgtaactttggtcggttacaaggcgacaatgtattttgtaatctagaccaccgcctttaaagcggcttgtctgagaagctccgttcacgcagggcttctttttcttccccgcattatagcatgcctttaattatccttcgactattttaaattaactttctaatagttctaggggacgcacgtttttttgtactaaaacaaaggtaaaaactagtagacataatcaaaatattttttgatcatgaaccgtacagtgtgctcttctcaattgataacaaggcctttggtgcaaactgtgagctgggtcctgggagcttgcttccattcattaaaagtcccgtttatcgtctcttagtgcagcttaaaataccaacggtgggcccattttagccacctcgcatgaatctttatattcaacacaatttgtagatcaatcagatcgtccaccaatttgcatagacaccatatatagtgctataatgatcgttaacaaagtatataagggactaccattcatgccgatcaaccaatcgctaatttgatgagtttgggcttctttataagccaaataatctttgtgccaatcaccaagatttttgaatccggtaataatggcgtctttttctaggctattcaaccatagccgcttaatggtcttctttttaacgtcaatctgggcttggctcatgattgaccacgcaatattagagccttcccgatcactatcggtggcaacaataatggtatcggccttcgttaacaggtctttgaaagaccctcgagtccctctgcaaaatacttgcatgtcaagcgagatattttagctttgctggcaccagttacagcggtgacttgtttgattgagtgtccttgggcgcgaagcaagaccacctgaacgcgacgaattgcacgcgcattttcgtggtgttcgaaggttgtcttgagctcattaatttggttttcggtgtatttaaatatttttggcatgatgaaagcataccagaaaaagccgtgggattaaacggcttatattagatcttatttagtatgaatttgggcaatgagttctgggccgtgccaaactacgtagattagcaatcctaacaaattactcttgagaaacaaaaaaggcgagtgaatctccgtatgtgaagattcactcgtcctatttagtaactatgaactgttagacctacttttatgaagcagcctttcctttcggctcgagtcggcgttccaagaagccgaggacgaggtcggagatgatggccattagcgctgtcggcaacgcgccggcgaggatgatggctccgccgttggtggcgttggtgccgcggatgatgatgtcgcccaggccgccagctccgacgaaggcgccgattgcggtgatcccgatggcgacgaccaaagcgttacgaatcccggccatgatgaccgacatgcttaaggggatttcgaccatatacagtgactgccagcgggtcatgcccatgcctttagccgcgtccatcaggttcttatcgacattttgcatgccggtgtaagtgttcttgatgattggcagcagcgagtataagaagaccgtgacaatgacggtgtttacgccaagtccgagtcccagcatgatgatcgaaagcatcgctaggctggggatggtctgaatgacgttggcgatgccgatgactgtgttactcaaggtgcgatggcgcgcaattgccagcccaaccggaatgccgatcaccgctgcgatgagcaccccatagatcgaaatcagaaaatggcgggcgaactgactcagcacgtaggaaccattgttggcaaggtaataccagaattgctgccaagtatccatgttagccattagtcgtcacttcctttgaaatagttgtgtttggcaagaaacttttgcgcgaccacatttggttcaagtaactggtcgtcgacttgatagttgagttcctgcatggttttcaggttgatcttgccgtctaagcgatgcagtaacggttttagtttagggtatttcttcaaaaggctattattaacgaccaatgagcactgataaggcgggaagaagtttttgtcgtccttcagtactttcagattgtaactgcgaatccgtccatcagtggaatagccaagaactgtctgcattcggtttgcttcaacggcatcgtaaaccagaccaatctgcatcggataaacccgcttaaagtcaaagccatatgctttagtaaaatcgctatagccatcgcctttccggttcatccagctggagtcaacgccggcattatattgcggtgcgactttcttcaaatcggaaacggtgttgagattgtcttctttggcttctttttgcgtcaccataaaggcataggtgtcagaaaagccgtaagatggataccaggtctgatcgtagcgctttttgaactcgcgcttgacgatggcggtggccttagctgagttcttgactgggttcatgcctaatgtgccggtaatctcggtgccggtgtaacgcgtagcactaatatcggcatcgttgcggaccatggcttgatgcaccacggttccggagccgaggttattgaccaacgtggttttgtaacctagctcgtgattgattagttcggcaatgatattggccatgatctgcgactcggtactggtttgcgaggcgatccgcaccgtcccgtcattaccggagccgcctaagccaggaaagccgcagccgctcaacaagagaaccggaatcagcaaaagtgacaggaataattttttgaactgtttcatcttgccacctcctaagtgcgttcactgacaggtgtcaggtggtattccaaccgcccaagcaaccagtcaatgaccagtgccaaaatggtaacaggaatcgtgccgccgataatcagatccggctggaagagattcaagccgttgaagatcagatccccaaggccaccagccccgatgtacgaagccaaggttgcccaggcaatgacataaatagctgacaagcgaatgcccgccatgatcaccggcatcgccaaaggcacttcgacttgccgaatcgattgcatcgccgtcatgcccatacctttagccgcgtctattaacaccggatcgacatcttccataccgatatacgtattccgcagaatcggtaacaacgagtaaatgaacagtgcaacgatagctggcacttttccgatcccgaataaaggaatcatcaaggccaacaacgccaatgatggcaccgtctgcagcatgctggcaataccgatcacgactttagcggtcttaggaaaacgcgtcagcaaaatacccagcggaacggcggcgatcaccccaagacctaacgcaattgccgagatgtaaagctgttcccaggttttggtgatcagttcactgccatgtgcgtttaaaaaagcaaacatggtcacacctccttaggtgcgtctcggtcatctgccgctgccgaatcggttgccggttcctgatcggtaggcgttgccgactctttggcgctatcgctggcttgatcgtcttcattttcgccccagatggtgtcgtaaacgacatcaactaatgaagcacgggtgacaataccgaccaatttctgattgttatcaaccaccggcacatacttgaaaccgcgctttaaaatgcgatcagcggtatcgcgcagcaaagtgttcttattcacatagaagatactcgacttggtaatgtcgccaacgctagtagcactttgataccgggtttccagcgattccaaatcaatgaagcctttcagatgattttcatcatccgtcaccaacagcgtatcaacgcgacgtttacgcattagggaaatcgcttcagctagtgacttgcctggcgtgatcgctgcaggattcttcagcatgatctgctcaacggtggtcacatcagcccgcgcctgaaccaatcgatcctggccgaccaggttctcaacgaatttgttcgctggatgcgtcaacagttcggttggcgtcgcattttgaatgatatgcccgtggtccatcaccacaattttggttgcgagcttgagcgcttcatccatatcatgcgtgacaaaaaccacggtcttaccaagcttctcctgcagattcttaatcagttcctgcaaagcctcacgggtaatcggatccaaagcgccataaggttcatccattaaaatcagatcctgattcgcagcaagcgcccggataacgccgattcgctgttgctggccaccggaaagctcggatggatagcgatccagataatcttccggtaattcaacaaggtccaccagctccttagctttcttgcgtcgcttttcttccggccacttcaataacttcgggacaatggtgatgttttcataaatggtcatatgcggcatgaggccaatgttttggataacatagccgatttgacgccgcaatttgacggcatcgattttgtgaatgtccttgccgttaaacaggatttggccgccgctgggttccagcatgcggttaatcatgcgcatcgtggttgtctttccggaacccgacgtcccgataagacaaacaaattcacccttatgaatctcaaggttgatatgttcgaccgcgacattcccgccacgataaactttttcaacgtccttgaactggaccattggttgttcttctggcatctgacgcgccctcctttatttgatgattccataataacacatgaagttaattgtattttaattgaagaccggttgtggggcgggagttttgcgcgggttgggttggtgggtgatttgtaagttaactgggtgtatgaggtattccttaaagaggaaagttgatgaaaggactaaaagcttagttgtttgttaggaaatggaagtttatgattgagagagtacttttatggttatgttaaatcgaatgtcagtttctgacttagtttaaaggcttctgcgtttagagtgtctgagttataaactgggaacaggagtcattgttttggaaaaagctaagtccatactttggggaattatcttattcatacccatactttatctcgctgatggcgtttcgcttgttggctacttcacgacgaatatcacactaaactggatctttgtctttggtagtgtagcaatctccataacgttattgatgctactagatcgaaaaatacaaaagagatcttcagcacaaaaacagcaatcgtcgtttttaaaatatctgctgatgccgattatttgggcaatcttcattactgtgatcaatcttgtcttgaataatctcgcctttcttccgcattcaagtgagaatgtcttacagtcagaaacagctcaattgctgaaaggatcattaagatggccataaccgattattcctaaagttttcccttttaattctaatagcggtttttcccaagaagtaaaatcaggagcctgtgcccaccggttttcatgaacaagctgattatgcaatccaacttggctagtcacttctaataataacgagaaagtaaattgtgccactgcgtcacttgcatatgtgggaatgttagtcaccacaaccttgttctggtgtgcgctctcaatatcaacgacatcataaccggttcccatgattccgatatacttcaatcgtgatgttttgctaatcacttcatgatctaggggtgttttgtgtgtaatgacgatatcagcatatttaattcgttttatgatttcagcgttatcgttaactggggtacgatcatataaagtgcagtcgcctaattcttgcaagcttttccaatttaaatctttgtttagttcatatccatctaaaagaacaattttcatagtgttacccccctatcttttcaatgttttagctgcattatgttctggttgtttaattgccgggttttgttcagaaaatgctttcagttgtttttgcgttcgattactgatttcatggtgtacatcatttaacttattttttagtcctaacttttgttgtggattagttgcttgctgaacttgttgttgcaatccttgataggacttattaagatcatgggctgatagcttttttagattatgctcaggctctttttgggcttcttgtaagcctaattgtttggttaagccatcgctaagctcaatcactttgttgctcacttgctggatctcacttaaagcactatagatcacggctttatctttggcccaggtggccacgtaaccgagtgagtagttgctggtatcaacgccaatattttgcgtggcaacatacgcgatcgcttcggcttgggtttcctgataggctcgtggccgatctttaaaggctgattttaatccgtgtagctggctatgcgcatattcatgatatgtattaacatagagcttaaaatactggtatagcaatgtttaaaaagtgaatgcacatttatttaactgttattttaaataccatcgtgataacttgaggcagacaaggtttattcgttatgatatactaaataccaatttcactaaaggagttctctacatgtcaaattataataaagctttagcgtttgcagttaccttaacagcactttttactttccccaacaacgtaaatgctaaaacaaacgtgccaacaactaaaatacccaaaagtgagtcaatccatgtcattcaaagtaacactgattcccatacatataattttggaaaaaaacaatatgtaacagaaaaagtaaccaccgcttatggtttaaataatcagcagccaaattatcaagatccagtttctatttctaaaaatgttgtcttaacagtggttaaaaaaatgccaagggaaaatggatacttagtcagtattcctgggagctcggaaaacttcttcattaagaacataaacgattatacgtactccactaaaaccatcacactgacccaaaatggtcaaaagaaattattaaaaaattctttcaaatggtcaaaaaccttaaataagaaggaactaagggttcttcgatactacacaggcaatggatacacaaatataaataccgcactaagaagccccaataaaaatattgctaaaaaaataagtcaaaaaataaatttaattaaatacagtattgggacgtttaaactcgcttcccccttaaccgtatacagaggtacctcgttagaaggcttaaaacaatctttatctggtaaagcaattgcagatggtgagcaatatgaagaccgtgctttttcatccacaagcattaataaaatgattgcaactggattttctagtaaagttattttgaaaattaacttaccggaaggctaccacggtgcctatattgacccaatttccgaaaacaagggcgaagaagaatatttgctaaaaaataatactaaattaattactactaaaattcaaaaagttaaaactcatactatttctacgatgaagtttgtaaaaaccagtgccaaaggaaaaatcatttctcaaaaaaataagaagcatagttcaaatggtgcttattggctgattacactcaatttagaaaactaaaatcatatgtatcaaagctgagatttatttcccagctttttatttttacataaatttctcgatcaaataaataatcaacgttacaaaaatacccgctgctataacctattccgaacgaattaaaatcgaaaccttttgtgaactagggctgtccaatatccaaatgggcgttcggctgaaccgatcaccgtcaacgatttcttatgaattatctcgatgtcaaccttatcaggctgaattagcccaaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggttaacagaactacatatccgccactcttacagccgtaaggggtgtccatacgataatgcaccaatggaatcttttcatgcttccctcaaaaaggaatgtgtttatccagtgccggtctttgagaattatgaaactgccgctgctgtcctttttgaatatgtgcatgctttctacaataggaagagaattcatagttcactgggctaccagacccccttacaagttgaaatcgcaacacttacgagccaaatggccgcctgatttaatgctttccatggttcaaataagttattaatcacgattaatgatttatttgagctgtggaaggtaaacgcggttctgaatgtctcttaaaacctgtctcaaatattgacttcaatccataggatcgctaattttactttgactaattagaaacggatcaagttattgatagctactgatcggatctcttgatattaacaaacaatgaacagatagattggatcgaagtcactgtagataacaatagatcataaatttatccttcaaggaaacctagcatatgttatacaagtaaataatatttacaagtaaattcagtttacttgtaaatattatttacttgtataacataaagcacaaaaaaagtatcggttgtgctggctaaatttactgctctcgctctttttcaagtagagtattatacatatctttttgtcgattattcatggacgtttcagtgtatgtctgaattaaacggttaagaagagaatcgaaagttttcttttcatgggcctcctctggtggaagaaaatacgacaaaacacgtagtttctcaacgctttctttagaaacacgttgtactgtcatagctttttttttctttttgtcgggttgctttgattgagtctgcataccagtaattggcccaaaactgttttgccctttaatattaacagtcttacttttaagagaagattgaggatgctcgagtaccggcttaatttgtggcaattttttcttttgactatcgtccattttttaaccttcttcctcttgtagtgctaatttatgaagatcaatttcgtctaaaacattttcgaacactttatgtgcacgttgatcccactgatcgttctgaccagtataaattttacccattgatataccttcagcatcatatgctttaagtcgttcttgataagtaactattgtattcaagacgttattcccaaactcttggcgtgcatctgaaagtactttcttatcaacacgcccaccagcacgtaacatgcacggcagtattccaacaatgtccaattcggctccgtaattatcaatcagatattgcatgtagttaatgtaagtttttgcaccatcaaagctcagttcctgcgtttgtaaaattataatacagtagtctgatgccatcattgcattatccgaaaaatcgctaatggttggtggcacatctaggtagatggcttcatattgttctcgcaatggttttaacaattgtctcagatatgtaacctgtcttttatcatcgtcaggaaaagactgtaataacattttgggtaaacgactaaattgtgtattagacgcaattaaatcaagattaggaataatcggagtgatctgattagtaagatcaccgttcgtaaaaccatcggtaatattcttgctaatatctgttatattacctgttttcgctaatatactggtagcattggcctgtgggtccaaatcaaccactaaagttctcctgtgtttgtttaccgctgatatataggaaagcatagtcacggttttcgtcttaccaacgccgcccttaaaattccctacaacaaatacgtctgcactcatacaatcatctccttagcaagagtatacattttcgaagttgtgttttcaactgtatacaaaaaaatattttggccaattacaactttttcaaaggaaagtttatatttatttacatgtaaataaaatttacttgtaaataaagtttacttgtaaatattatttacgatatatggaaaagctatatagtagcggatataggcagtcatccatttacaagtaaataaaatttacttgtaaataaagtttacttgtaaatattatttacttgttatacaagtgaacttttgcgaatgtttatagacaccaataacgcttaatttaggctttacacaccaactggcgtcaggtacaatatgcttgtaaataaaaaaagggaacgcaaagttgcgaacccataaaaataaagataaaaaaagagaacgttgcgtgcatggtattgccttaccattcatgcagccacacaagaaccttcccttcttgcacgacctttttaacgttcagtcaaaaatattgagaatacttttcgtattgttttgtgggtgttagacacacccggcatttcaacaacaaaagtataccatattttgatgacgatttctatacataccccttaggaatcccgatttaatcatgatccatgatgattaatcagttaaaaaagagctgcaaggaaagtaaccttgtcgctcttttttgataggagatcttaatcatgcataccatcaagggaactaaacaatttattcgccaatttaacttttttgaaaaaaagggctttaacccaaccaagtgctccatcatcaatcatttatatgatcgcatggaatcgtccattaaacggcccctcgattattttgacaaagataaaaaagcgttttttatcatctactccaatgagcagatggctcgggatatcaacgtttctgtccggacagtcgctaactacatggccgaattagccgatgaacagtggattactcgctacaacacgccaaccaattctacttaccgcattttcattccacggtttgccacagcaagttccccattctggtacacccctagaaaattttgctgggggggctggaaaaaatttctaccaaatcagacttttaatcatactttgacatataaaacaattaatacagataatacacaaaatggactaaatagcgcgattttcacaagctcaccaaagtcaggaccccaaaccgtagctaacactccgcaaccaggggaaactaacggccagccaacttcaaaacaaccgaaaaccagccagcaaccagtgcttaacgatatggcaatcaatatcattgccgatcaactcatccaccaggggggattaccagaacaagccgtctcgattatgaaggccctctcctttggcaatgctgataaactatacaattacggcggcctaatctataaagctaaaaaagccgtctacaagaatcatcgtgaagtgaaggatattggcctcgctttgtcactcgaacaaaacaccgacatgcgcgacagtctagctgaaaacttgcgccgcattctattcaccgccaacaaaaaaacggctaatccggtcggggttgagaagtacatcatggtttccctgaaaaactattttgaagaatgcggtgataaattccttcaggaattgcattatgacccagcaaactatcctgaaaattctaatacccctgcctatgcctaataaccaagatcagctctaattaggcttagttggtatgccctaaaacccagtaaatttgttgtcgcctttatgctggatgatgcgtttaaagctgttagttatcgcacaatgggggggtaaaagcgcacccttgtctaatagcggttgtcggcgcatcttcacatggcctagtaaacacgggaaactggacttgaggatttgtgtcaaaaccataactttggagtccacctttacggcacatttgggcattattgtttgagaaaatggtcgttaggtgatcgctaatagctttgcgcttgttgccctcgatgccaaaccaaatagatttagttttcttaaaaagaccctttcgttgacgttgccagtcaacacggtatgattaaattaacgaatgtaagcgctgtacttcgagaggagaatcaactatgaaagttcttgtaattggcggaattgccggcggaccctcgtttgcaacccgacttcgacgaatcaatgaggatgctgaaattatcatctttgaacgtggcgcggcaatctctgttgccagttgtgccctgccctattacctgggaggcttaattaaggaccgctcggcagtcattgaacggacgccggagatattaaagcagaaaaataacattgacgtacggttatttaatgaagtcacccagattaatcccgatgacaagacggtggcagttaaaaatctgcaaaccggtgacacttataccgaggattacgacaagttagtcatcgcaaccggtgccagtcccacggttccagaaatttccggaatccatgatgccaataatgctttcgtattaagagcggtcacagatgcagataagatcaaatcatttattgatgaaaaacatcccaagacggtaacagtccttggagccggttcaattggcattgaagtctcagaagcctttgttgacaatcaaatggacgtcacgattattgaacaaaccggccacgttgctgcaccatttgatcctgagattaccgatatcgttgccgacgaactcaagaagcaaggggtccacgttattctcaatgaaagtgtcaaagagattcaggatcatgggcataccttaatcttagacgatggctcagtccatcaaaccgatatgttatttttaggtaccggagtcaaaccgaatagtgagatcgccggtgcagccggaatttcactttctgatgatcaccatattatcgtcgataatcatctgcagacaaacatttcagacatttatgcaattggtgacgtgattgaaacgaccagtttaatcactggcaagccaattccaagcctgctctcaagcgctgctaatcgccaaggccacttgctggcggacatgctaaacggcagtccgttggaatataaaggattcattagcgcaggtgtttccaaattctttgacttgactgccagtttcgtcggttttaccgagcaaacgcttcaacaaatggggatcactaactatcgaaccgtattcatcacgccatttgatcgggcttacttctaccccaatgccgaccgagtcaacttcaaattgatttatgaagatcagaccggtaaaatcctcggcggccaagcagttggccgaaacggcattgataaacggatcgcagaattgtcggtcgcaattaccggtaacttgactgcgtttgaccttccatctctggaaattccctattcgccaccatattcttcaacccgtgatgtactgaatatcgcaggttatgtggccattaaccagttaaccaaccaatcagccacgatcaagattaacgacattcctgacgatgatcttaaaaacgccgtgttcctggacatcagggaagctggaaaaccagtaactggatcgatcaaaccaactttgaatattccactttcagaactccgagagcggattgacgaggttcctaaggataaaaaagtttatattaccttccgaaagggtctcggcccatacaacgccacccgtgtcttagctggaaaaggcattaatgcaactatgattgaagaataatgaatcaataaaaggggattttttggacaaaatgttcatttagccccctttttctggagcatcaacgtataatatatgtagatgggagtgtgatgacatgccacgcaaactaagaccaaatgcagccgttaaaaaagtcttgaagatttatcaacaaaactttatgaggaaccaatttacggcacctcaaaacgatgcgctgcatttaatatttaacttaggatatacagttagtccggacgtcaacgaaagttcatacggctatgtcaaagttgtcaatatggacacgggaaaatcgctcgtcttgactaacctcagcggtaacaaggcgctattagatggtggaaccaccattatttctgaaccagatcttgacctggacacatttgattatgttgattatttgaattcgaaaggtgacaatccggattatctggcaccaaccgtcgcaaatctgaaaatgctgcgaaatcgattaaatcaattgaatgcggattttgatcgcttgaaaaaattgcgaaatgattatcaagaacatctgaccagtattgactcagaatacaataagaaagttagttctttcattactatcgtcaatcaagttgaacgaatgtccaacaagataactgaagaagatggcaaaagtaacaattcatccaagtaaaagtgggaattttcccgctttttttattttatcacaatggttatttatttggtacatattttatttaaagagggattattatatttattttattccaagctaatcagattgttattatttttacccctaattttcatattcactctataaacttaccctgttgcataattgtttgcaaacatattttttggagggaattatttcatgaacatttcaagaatcgcattggcatcacttgtttcatttggtgtattaggaggagccagtctcaatgcttcagcaaatcacacccattatcaacgaatcctttggaacaagaccatggcacatcaaaaagtcgctttgaagaatggtaagggcattatttggaacaaaccatatagaactgccaaaaattctaaaattacttatcgtttgtcacacaagaaaggtcttgtgatgaccactcttcgccatatgaaggttaagaatggaagtatttactactttgttaaggccggtaagattagtggctggattaacaaaagtagtttgaagcttgttaagaacagctctccaaaggctgagaatcaaccttctggtacatccacagttactccggcacaaccaactggatccgttccaaattccgttcactatggagatacgacaaataatcaaaatccagctaagaatggtcaaagtacctcagcttctgttaataattacccatccgcctcttccgttaaccattacccaacggattcaagctcacaatcaaccgtcactccagcaacagacctgttcggtagttatacaaccggtcacattgtggctttaccagtcaagtccgataaaaaaacatccaaactttcaaaactcccacaaggagcagtcgtttatgaaaaggtttggcaggatggcaaactcgttgaaagtaacgtttcgtcaactatcgctgttggagcgcctgtaaaaattgcattgggcgatgaaaatccaacttcacaactcttagttcgtaccttagatggtaaagtttccggatacgttgaccgtaaccaagtttcaattggtgatctaacccaagcggaattgaatccaaccacaccaaagacaccagctaaaactgttacacagacgccagctgcatccagttcagccaagtaacaaatttgggagcataaccgctccctttacatacaccccaacaactaatcaccaacataaaactaagccatcttctaaatccatcaaattcccccaaccccctgttatgacaactaccactcgccactgcaagctttcattcatttgcaatcatttttatctttggtaaactagttgtcatcgttaacaggaggtatacatggattcaaaaaacacaacaaagattggactttttcaacttgtaatgctgacactgggatcactaatcggttctggctggcttttcggttcttgggaagccaccaaaatcgccggtccggccgcaatcatttcctgggttattggaggaattgtgattgctgcgatcgcatataactacgtcgaaattggcgcaatgtttcccgaagctggcggaatgagtcggtacgcccaatattctcacggcccgctgctaggattcattgcttcatgggcaaattggatttccctaatcactttgattcccattgaagcagttgctgctgttcagtacatgagttcctggccttgggcttgggcgaactggacgcattctttcttaaaggatggcacgattactacctcaggcttgatggtcgtattcatgttcatcctagtgttcacactgttaaatttctggtcagtaaaactattgaccagtttcaccagtttaatttcaattttgaaaattggggtccctgccctcacaattatcatgctgacaatctcaggattttacccacaaaattatggccattcaattcacgaatttatgccatacggctcggcaccgatcttcgctgccacctcagccgcaggaattattttctctttcaacgcattccaaacggttatcaacatgggaagcgaaattaaaaagtcccggaaaaatattggacgtggaattttcatttcactgctaattagtggtgtgatctatattttgctccaaagcacctacattactgccatgaagccctcaaccctagccgcaaccggctggagtgggtttgacttcaactcaccatttgctgatttagcaatcatgcttggcatccgctggttatctgttctactctacatggatgctttcgtctcacctgtcggcaccggcgtttcctttgccgcgtcaaccgggcgtgcgctttatgcaatggaaagtaaccaacatatcccaagcttcattggtaaaatcaaccaaaagtatggcatcccacgagcagccatgatcgtcaacttggtattaagcatgttgatggtctcggtgtttagatcttggtccacattggcaaccgtcatttcgacttcgaccctgatcgcttatctgactgggccggtgacagccgttgccttccgtaaattggcccctaattttaaacgtccgattaaattgaagaaccttggttggatggcaccattgtcctttgttctggcctctctagccatctactgggcaatgtggccaacgaccgtcgaggtcatcttggtcattttggttgggctgccgttttatttctattacgaacaccgggccggctatgtcgacaccaggaaagctttctactcaagcatgtggatgattatctatctgatattcatctcgattatgtcctacattggtagtgaacagttcaacggaattaattggattcactacccttgggacttcgttgtcatcgccctagcctcacttgtgttctattattggggcatcaaaacggcgcacgtcttcccagacttttaccaagccaaggaactcaacgacaccgtcaaattggatgacgattaacatctgatacatcataaaaaagccgacaactgcatgaactgcagctgccggctttttgggttcttcgtcaactgttgttggtgaacaaaatattgactgtataagttcccttaaggaaccagcaccaatccaggtagggtgaaggaagcaacaagcgaaacaacgaagcaagccacaagctagcaagttaataccatcacccaaccgactaggctgatcacgcgcgcatactatcagaggataatataagctatagaccagatagctacacttacttgtaccgtaagtcatacgtcgtagttccctcacgacgttccctcttagtgatatttagagaagtctaaatagatccacacgagattataagttatccccacgcaaacgttataatcatttacatggtagcaccggatagtgtttagactccatctgaattccaacattaagtatgcctccaagaagaagcccaagatcggttccaaccgagcaacaagtcatcactgctgcacctcaaccccaagcaattagttctcctctcactagaacaatactcgatagagatatcgtcctcaaaagtttcaagaccgctggtgtcaaagatttcgccggagaccaatacggcaagaagtctaatgagactaaaacagatcatggaaagaatatgttagataactccagagcggcacaaaactggttgaaacgttttgaaatgattgctaaacaacgtaaagttccatctgaagatcttgtggagatcagttatactttctttgcagatcgtgcattagattggtacaataatttgagtgatactgccgacttctcctccttgacctgggaacagttcaaagagaagtttgaaaagaagttttgtcggagtagagaatctcaccaatatgcattgacaatgttgaatcagttgccatttgatgaagaaaattacgatgacttcaatagggatttcgaaacatttgcatcattcactgatcaaactcctagtgctctcgttgtgttgtacactgcgaaattgccacaggatgtcagaacatttcttggtccacatgtttaccaaacttaccaagacttgattccgatagttgaccgaagacttagagaagttaaaggtaatgagattgttggtaatgccactcaaccaataatcatcaataaatacatctattcgaatggtaatggtcaacgcaataatcaatcctctcgaaaccgtggtagaaattacaagaattctaaagacagaagaaacaaacgcaattctcattatcatcacaacaataataataataataatgattcatctgacagaagtagccaacgcggtcatcctcgccgtgataataagaagtcaagtgtcgctacttctgatcctagcttccggacacttgccgtgcctgctcatgaaggtacgtcccaaccaagggatttttcagacgacccttttacattgtataacagccatgtagaagaaatcagtgaatctccttacattgtggatatcaatactctgcgtggattatttcatccccctatagtgagtccgcgattagctaccgtggaaatcgataggaacgtttatcaagttttacttgatacgggttcaacggcggatgggataagtgtgacgacttttcacagaatgcagttaggtcgtgatttttttaggtattcaaagccgaagaaaggaaaggctttgcaggaagaggttgatatcctggggttcgtcacggttcagttaaaagttcatctattatcaggtatcattgattgcagaaggtcacttttcatctttgattcctcacaaccaatttttattttagggttaccatttctacaggatttcaaacacaatttgacattaaacgatttccttcatgatcaagattcaaaggttgacaagtcaagtgaaaacgtatgtattaagagatttgattatgaggaaagttatgttgataatttactaacagattcgaagaatgaattttgtttgtgtttggtaacaaaggtaactgatgaacgaggatcctgttccgatatgttggatgttgacacaaatcagtatactagttctgttaagcgcgcggctgataatcaggaagattcacattgtaaacagtccaccaacatagaagcaaatataaataccgtcagaatagacgtggaagatgaaaacgcgacagcgagaaaattccgtgaaaggataatgacagaatttgcagatgttgttacaaatgatacaccaaagtctttaccacctattagacagcacgaacatcggattgcattgatcaaccctaagaatgttatatctaggaagcaatacccgttaagtcatgctgagagagttgagatgacgagacaagttgaagaattgttaaagttaggttttgttagaactagttcaagtccttataacagtccaattctttttgttaagaagaaagatggatcgatgagaatgtgcatagactttcgattactcaataacaacacagttaaagataaattcccgattccaaacatcgagcggttgacagctcatttgggaaaagcgaaagtttattcaaagttggatttaatgtcaggttattatcaagtcagagtggaagaagatgcgataagtaagacagctttctcaacggattatggacactacgagtgggtagttatgccatttggtttaaccaatgcgccatcaacttttcaaagactgatgaatgagactttaagacctttcttaggaaagtttgtccaggtttatttggatgatatattcatttactcacccaatgctcaagctcattatcatcatgttcggcaagtcttgcaagcactacgaaagaataagttgatagcaaagaagaagaagtgtgcatttttcttcaaagaagtaagatttctaggtttagttatttcagcgcaaggtatcaaaactgatccagagaagatagagaaggtgatgaattggccaacgccaacaaccatcaaagaagctcaaagtttcataggactagcaacatactatagacgatttgtcaaaggtttttcaaagattgtagtgccaatacataacttcatctctcataaagctgaatgggataaagctcaagatgattcgttcgctagattgaaacaagttttgacgcaagcacctactttgattcatccattgtgggactcgcggtatccatttttggttcacactgatgcatgcggtactgctttaggctacacattagaacagctaagtcctgaaggaaagtcattaggcgttatagcgtatggttcaaagaagttgaaaggaagtgaattgaattactctatttatgatcgagagtttatggcagttatagaagctttgaagacatggaaatattatttgatgggtaaacatttcataatcagaacagaccataagagtttagtttatctcaaacatcaaaatttgatcgattctacacgagttgcaagatggttagatttcttagctcaatatgattttgaaatacagtatgtgaaaggtaaagataattctgctgctgatgctctatcaaggtatccagagttgtctgctattgagattaatcacatatttgtcgatagaagtattgagaataacattgagtttaatgcgatggacaacgcacaagctttacaaacgctttcgaaaatggttccaaatctagaattcaaagatcgattgattcgagcgtataagacagactcattctttgcagacatttacaaggttctctcaaaaggtactagaagtattccaaattccattagaagatacataaaacactacagagttgaagataagttgttatattattcaacattgttatccaaaccaaactggcgtttagttattccattagaaggttggttgattagcagagtaatatttaatgctcataacaatcgtgatgctggacattttggttactggaaaacgtatttgaatttgtgtgatatgttctattggaaaggtatggtgaatatggtgaagagatattgtaatcaatgtgttcaatgccagaagaataatacgtcgacacaaagactccaaggtttattttgtcctctaccaattcctgaaggaagatggacagatgtcactatggatttcgttacaggattaccaagtacagttaacggaaatgatatgataatggttatctgtgatcgaatgtctaaaatggctcattttattccagtgaagaagtcattgacagctgaacaatgtgcaagagtttttatttcagcgtgtttcagacatcatggtattccaaagagattggttagtgataaggatatcaggtttatgaacaaattttggtatacaatacattttttgttaggtacttcgttattgttttcaacaacaaaccattctcaaacagatggtcaaaccgaaagaactaacagaataataatgcaatgtctaagaaagcactgtgcgaatgacatgctgcgatgggatgaacatttggttgccattgaatttgcttacaatagcacttatcaaaattcaatcaaaactactccatttcagttagctttaggatatttgccagagtcatttaagaaggtcaatacagcaatagatgttgatagatatagtgctagtgctgaaaagtactttgaaatgatgaactcagcattgatacaagctcaagataatattgttgaagctcaacgaattcaagagaaacatcataataaacaaagaagagatcatcactacaaggtaggtgattatattctcttggacaaagacgcgaatggtatcaatcctcagtattacaaagttcaacctgtattttatggtccttacagattagtcaagaaagaaaatgacaatgcttttgaagttgatttacctacgatgaataaacgtgatagaatcatcaacgtacaatggttcaaaccatttacacaacctacgtttatcagtcgaagagtacctcaaacggatcgtgaagttgacgctagaattaatgaaattgttacaattgcaggttttaacaaacaagatagaacttacgacgtttattggaaagacgctgcaccaacgcatgctacaaccataactgaagagcaatttaacaaagcaccattgtctttaagaaaatgcctactttacaatgcaagattgattaaggattacgaagaacttacaaagtgaacatcgggacgatgtttccccagacgggaggatgtaaggtataatctcgtatacctactttggaaaaatgaggtcacatgagcattacccgattaggaagattaagcgagttaagaccgaaggcaaaaaggaaaatgaagtgcgaacgcctctgaccctgacaagagggcagagaaggcaaacgaactccgaaagtctacgggttccgataggaacgcggggaaggctgaaggcgagaacgtgcggcgctaaactgagataaggaaagctcaggatacaaaaaggggacgtagtcacttgaagtataaactcaacctttagctgacagggggattttcttgataaaaaaactaattttcttttaatgagtaagcatgtttgagcatcaatggtgcaagtaatgttgtcagaataattgctgtgattatggctgaataatattcagaggacagtaagtgagcactatagccaatttgtgcgataatcaaagccatttcaccgcgggacaccatgccggcaccgacaatgtaagaatctttccaggtaaaatgggccaatttagctcctaaaccagcgccaactaattttgtcatggttgctaaaattgttagtaaagcgatgaataaaaagtcatcaagaaagccatcaaacgacattgaaagaccaatgctaacgaaaaaaacaggaataaagatggcgtagccaatcggttcaatgttttgctcaacctcgtgctttacactagtttgagaaattgcaattcctgcaaaaaaagcgccaacgactgaactgagcccaattgagtccgccactaatgccatacctaagcacaaaataagtgccacaattgttggcccccctggaatgaataatctctttccaatttgggctaagaaaggtgccagaaatttaaccacgaaataaatagcgataaaaaacacaatttggcttgcaaaagtgaacaacaaattactgctatctactgcacctgcttttgttcctagcaaactgaccattacacttaaaatcaccacggccaaaacatcgtcgactacagctgcaccaagaatagttgctcccgcttttccgtgcagaccatctaattcctttaaaactgcaactgaaattgaaactgatgttgctgcaaaaatgacaccaataaaaatactttctgtttggtctagtttaaaggcaatgcttaagccataaactaccagaactggaatgatgactcctagtgaggccaccagaatacttggtcgcaaatatttttttaataatttgaggtcactttccattccagcactgaacatcaaaatgattactccaatttcagaaaataggtgggtaaattcatcacccttgatccaaccaaaaatagctggaccaacaataattccaactagtaattgtcccaccactgcaggtaatccgattctgacactgtaatgaccagcaatcgtggtagcaattaaaattaaacatagttcaccaattgcttgcattaattttttcctttcaacaaaaaataaaaagcccaaacttcaagactttctcacacccctgagaaagtaaagtccttgaagcttgcgccaaccgatttgtcctattcatctactagttaaacattaccatagttccacctagctgtcacatgcttagactttttgtgtggctggggttgattaaattggtagttgaaataaatgaaaaacaacttatagcatggcattaatcattacacattatttgacttataccgaatatttttgtaataatagatccaattcgtttttttgcgtatatcgcataaccggtcattttaaatatgtttgttttcaaaatgaaagcaacgctaaatgtaactgaatttaactaaaggaggatgcatgactaaaaaagttgaagtaaaaaatttaaccaaaatatttgggaaacgtagtccgcgcgtcaaagaattaattacacagggcaaaacaaaagcggaaattctagaacaaacaggtgctactgtcggggttaatcaagctaatttccatgttaatcagggcgaaatttttgtaattatgggattatctggtagtggtaaatcgactctgattcgaatgataaatcggctaattgaaccaactcaaggaacgatttctattgatgggcaggacctaatgacactcaataaaaaagagttacgcgaagtgcgccgacaaaagatgagtatgatctttcaaaactttgcgttgtttcctaatcgcactattttggaaaatactgcctatggtcttgaaattaagggtgtcgaaaaaaatgttcgggaacaaaaggcccatgaagcgttggagttagtcgggttacatggctacgatcatcaatttccacaacagttatctggtggaatgcaacaacgagttggtttagctcgtggcttagctaatgatgccgaaattctgctcatggatgaagctttttctgcattggatccattaaatcgaaaagacatgcaggatgaattgctcgatttacaagaaaaaatgcataagacaattatctttattagtcatgatttgaatgaagcccttagaattggtgatcgaattttgatcatgaaggatggtgtgatcgttcaaaccgggacccctgaagatattttgacccatccagccgatgattacgttaaacgattcattgaagacgtggaccggacaagagtcttaaccgtggccaatgtcatgattcgtcctaatacaattaacattgacaaggatgggccccggctggcactacgacggatgcaagaaaatgaaatttcgtccgtttatgtggtcgatagtgcgcgtaaatttgttggctttgcggatgccaaagatgttgttggcctgattagaaaagagagtcgtgatctcagatcggtcgttcaaactagtgtcccgaccactcatcccgacgtgccagttaacgacttaatggataaactatcaagtaccccaattccgtatgctgtccttgatgacgatcaccatctagtcggaattattgtgcgtggtgccgtgttaggtgccattgccggaaatggagtggcacaagaatgacaattttaattagcaagttaccattgtctgactgggtgaactcatttgtcacttggttgacgcaatttacaggctttttcaatgggattacaagttttattggtggaattgttaatggctttcagtgggtatttgatttgttacccgtctggttgttcattgtgatcgttttggcgattacttggtatgcaactcgccatggtaaaaaatggggactgttactttttgaactagctgggttgctattaatttggaacttagactattggcgtgatatgacacaaactttgacgctggtccttacctcgagtttgattgcattagtaatcgggattccgttaggtattttaatggctaaaagtcatacatttgaagcaattatgaaacctattttggatttaatgcagactatgccagcctttgtttatttgattccagcagtggcattctttgggattggaatggttccgggtgttatttcatcagtaattttcgcgatgccaccaacagtacgaatgactaacttaggaattcgtcaggtaccggttgatttaattgaagcagctgattcatatggatccactagctggcaaaaattaattaaagtgcaattaccattagcaaaatcaactctaatggctggggtaaaccagagtatgatgctgtcattatcaatggtggttattgcatcaatgattggtgcattaggtctaggaacccaggtttacttcgctgtggggcgtaataatgccggtaatggatttactgctggtctggcgattgttattttagccattattttagaccgcattacacaagcatttaatcgtgcgaaacactaggaggtaactatgacacgtaaactaagaattttagtagttggattgtcactgttgcttctgacgatcgggttatccgcttgcagtagtaaacctgctgcatataacccgcataagaagttaggtccgcagattaactatacgattacaggaattgatgcgggtgctggtgaaatgggcgctgcgcaaaaggcactgactgcctatggcttgaaaagtaaaaattggcagttacaaactagctctaccgccgcaatgaccagtacattggataaagcaatcaaaaatcaccaagcaattgtaattactgggtggcaaccacactggatgttcaccaagtatccaataaaatttttgaaagatccgaaaaatgtttttggtaaaacagagaatttgcacaccattgctagaaccggtttcaaacatgacaatcctggcgcttataaactattgtcacagtttcattggactaaatcagaaatgtctgaaattatgttgaaggttaacgatgggcaagatcctgcaaaagcggcgaagaactatattagcaaacatccaaaacaggtggcaaaatggttggctggggttcctgaaggtcatggaaaaaaggtcaaactaacctacgttgcctgggattctgagattgcttcgactaacttagtcaagcaattattagacagcaagggctacgatacgacgattcagtcactggaagcacagccgatgtgggcttcaatcgcgactggagcggcggatgcgtctgtttcagcttggttaccaacaacacacggattgtatgctaaacagtacaagggtgagtttgttgatgtgcgggtgaatttgaagggtgccaaaactggtttagccgtgccaaagtatatgaaaaatattaattcgattgaagatctaaaaaataaataacaacaaagttgaagcttgaaatttacttcagcttttttatttacttttaaaaagttacattctagtggctggagtggtacgctaaactttataatagttgaattaaacagaaagaagagtgattgtgatgtcaatttatgattatgacgttacctcggaagatggtaaaagctattcaatggaaaagtaccgtggccatccgttgataattgtcaatacggctactaaatgtggctttgctcctcaatttaagcaattagaagaaatttaccaaaagtatgaaggtcaaggtttaattgtgctaggatttccctctaatcaatttaagcaggaactatctagcagtgaagaagcggcgcaatcatgccgcacaacctatggcgtcagttttcttatgcacaaaattaatgatgtgaatggaaaaaaggcgttgccactatttgattatctaactgagcaggccccaggcacgcttggttcagcaatcaaatggaattttactaagtttatcgtggataaagaaggcaatgtagttaaaagatatgcgccaaaaacaaatcctttaaaaatggttgatgaaattgaacaggtaatttaatcgtcaaacactgaccacaatgctgatcagataaattacgaagtccaacattaaaattaaattagaaaaaatgttgacattctaatgaaacttcgctaatctaataacaacatcaaatttggaagggagtaatcgtcatgaaaaatactataactcaaaccacagtgacactctctttccaaaatttagccttattattaaagaagaaggacctgacaagctgattttcgttgttgaaaatcacaaagttaagcccttatttcagtttttagaattaaaccattaatttattcgtgttcagcgtgatcctttgatttggcactgttttggccatagtaagcgttgacaccatgcttacggtaataatgcttgtccaaaagatattgtggtacgtggatttcgtcacgagtcaattgcaaagcatggtaactaatttcagctgaaacttccaataccttggcattgtacactgacttatccggtgttggtccccatgagaaaggtccgtgttgactgactaacacagctggtacagcatccgggtcaatcccacgtttttcaaattcatctacgataactttaccggtatttaactcgtaagcatccttgatttgttcctcattcaaagccggtgcacatggaatatcaccatagaaagtatcagcatgtgtcgtgctgacagctggaatatccattttagccgcggcaaaggaaacaccccaaggtgaatgtgtgtgggtaatcccaccgatattaggaaaatgattgtacaaataagtgtgggttggtgtatcacttgatggattcatgtcgccttcaacgactttaccatccaagtcaaccactaccatatcggatggcttcatcttatcgtactcaactccggatggtttgataacgaataagcccctatcccgatcaattccggaaacgttcccccaagtaaaagtcacaaggtccaacttaggaagctgcatgttcgcttcataaacttcttgtttaagatcttctagcaaagtaaaaatcctccatttatttaactgctggttcttgtttgataccaactttttcaaagatatcatcaaagaattgttttgccaccttaactttttccagtgggtctgctgaattttccgaccacatctcaatggtatatgccccattataatctaatctctttagagttcgcaagcacccttcaaaatcgacagtcccttttccaaagggtacatctcgaaattggcctttagaagtcttggacacaggagttgtatcttttaagtgaacagcagcgatattatcaatatttgattctagctctctgccaacatcattttgcggccatgctgttaaattccctagatctggatatgcttgtaaccaaggactatgaatttgggttttaatttcagcaattgtgttcaatgagttaatgaatgggtcatccatcgtctcaatatcaagcattatttcttttctagctgcaatttcaacggcctttttaagtccttccataaaccattcacgtgattgaatcgtttttggctcataataaacatcgtaacctgctagttgaatatttctaatacccaaatcactagctaaatcaacagcctttgaaagcatttctaaagacttttccctaatatcaggatcggatgagcctaggggaaatctacgatgaccacttagcattagtgtatggagtcttattcctgttttccatgaagcatcacgcacttcttcacgctgctttttggtccagtctaaccttgctaatctttcgtcactttcatcaacagaaaactcgataaagttaaaaccgagttcttttgcaatttccaaggtttctaaccatgacttatgtttaggcaaagctttttcatatattcctaaagaattcattatttatcaatcctctcttgcatttcttttaattttgaccacccatgattaagtgtatgaagtagatcaagatatatttcatacttctgagtatagatcttatactgttcctcgtcaggtttcacatggcttttaagcttagacatacgtttaactgcctcatcaacattcgaatacaaccccgttcccacagcagaggccatagcaccaccaaggccacctaactcagatccttcaaccgtttcaataggtatcccaagtgcatcagcaaacatttgcacccatgcacgtgaattggtgccgccacctgatatcctaatcgctttagggcgatgccctgcaactttaataagtttctcaatatgatatctatgggcaaaaataattccttcataaacggaacgaatcatcgccaattttgttgtattactttgaatgccaatgaaacttccctcagcatctgggtttacattagaaccataaaggaacggaaaaaatattgctttagaaaacctagcatcagtatgattcaaaaattcttccaaaacatcataaatagaccttccatgagttttggcattcttaatctcctcactcattaacgttttgatcattatgtctagattaccagcagaggttgcgcttgaagcctcaacaagatttaatccggttggataaattgaattcatcaacccactttcttgtttagcacttgtttgtgatggaaaaacgttgatattccacgttccaacaatagaactgaagtagtcgtcatttaaaacacccgttgctaatgagcatgcatcaatatcaaacatgccagcataaactggtgtaccttctttaagtccggttctttctgcggcttcagatgttacatccccacaatagtcactaaatttctttaatggtggcattttatcaaacatttcaggaattccaaagaaatcaaataatttcttagaatatttttgatccgataggttcataaaattatttccagaagcgtctccatattcttgattcactctatcagtcaatcgaaaccgaatataatctttagcagccagaatggtgccaatcttgtcatattttgtccgatcataatcttttaaccaacgcagcaatactggagattgggtttccataacatgctgatgactaatttcatatacatctgaaacatgtttttcaaactcttcagcaagcgaagttgcacgtgagtcagttgacaatattccgtgcataaacactctatgccctttatcaagtacgtagagtcctttcccatgaccaacacatgaaacaccattaatttgatcgtttgtaatccctgatttagtaatcacctgacgaatggctttgctaatcgagtcccaagattcgtccaaatcaatttcatgaaaaccagattgctcctcaatacgtggtgttggaaatgcaacagtttgtatttgtttaccatcatcattaaatataatggctttcgtgttcgttccaccattatcaatggtcaaaaaatattttgtcattttattatttccccgctcttagcttagaaatcagtaatatgataaatcgctacctcatttgattctcgattagcagacaataggtacaatttattgtctttagagaaaatagttgcattacttggaccaacctgtttatcaatgatttgagtagtaatgtccccatctttgcttccgattaattcgagattttgagcaccttgacgaaagccaaaaacaaaatattgatttttaccgatatttccgccccagattgcgtgaccaaatggtgttttcggttcactataatataacgttttaaattgatcattataaattctgatgtatgagccatggaatccttcaatcgccaaatactcagccttaccatcattattaatatcagcggcagcaatatcgcttgtttctttgttagaaagttttgtgagtttccagtcatcactagtagttgggtaatccaaccgataaataccatcagcagaagtaattaatgaatagtctcccatattcttatatccatggtttttagtaagtcgggtatcatcaagcgcatgaaggccttcaactcgttctttattatcattataatttcctaccaagaccttgccaggatcagtccagtcgtcagtatttttcttagaattagcaattgaacagccaacaaaccaaagcccattttcatgaggaataatatcaaacctatgaacatatgggaagtttccgacgattgattgatcccatccattgccattgaacgtttccttaacaatgcgacaccgtgctgaattaaatccaggatagaatctttgcgttgctaaaaagttcattgttcctggaatacgtaccaaagtcatagttcccccaacatcaagccaaactgtagtccgtttgtatgaatcattcaaatcataagcgtaacatggctgattttcttcagaagcaacaatgatgtaatcatgactcccgtcattaattcgtgtaattgcataacaatggtcaagcttatccgaaaaaaactttagtaaattttagtaaatttcattataataatcctttctccaaatagattttcttagtttatgttaatcgattaactatataaaatcaaaaataatttgcaaatccaattagggtctgtcttaaaaaaagctaatccggtataatctggataaaaacgaattgaggtcttggcatgacaatccccaaacgctatgaaataactgacgagcagtggcagcggattgaatcactttttccaccatattgcactggccgaccgcctaaattatccaatcgacaagcttttaatgcgatcctctggatcctaaaaagtggtgctgcttggcgagatttaccggaacgttatggatcttggaaaaccgtttatagtcggtttcgagttttggcagatgccgggttatttgaaaagctgtttcggcagctgattgacgatccagacctagaaaatgtgagtttagattctaccagtattcgcgtgcatcaaaaagccactggtgctaaaaaaatgcccgctgcctcgtcgaaaaccaagccatcagtttaaaccgtggtgatcgaacgaccaaaattcatgccgtggttgacggtttaggcaacccgttacgctttatactgactggcgggcaagttcatgatagtcaggctgcccaatccttgttaaaccagctggatctagctggggttaatgtgatcgctgataaagcttacggaacaactgcgttacgtcaatatattgaagccgaaagcggccattatacaattccgccgaaaagtaatgcccagcagccatggccgtgtgactattatgtttattgcgaacgccatttgattgaaaattattttaaccatctcaagaattatcgacgtatcgccacgcgttatgataaattggcgcatgtcttcttggaagcgatatacatgaccgccattttaacttggattaaatagttttcagacggaccctaataaaacgatttttaaataaaataatatatttaaaaaataaagaattcaggaagtcatctaaaatctattagaaaaagcatgataatagtcgttcccggcatttatctagttgattaaaggaattccaacaaactattcttgcaacgaaatttaaaatttatgcatcttcttctattcgattaattggaatagtcatttgttgaatattccagtgcctctccgccaggagaccaccggaatgcgccccgttcaattacagccccatcaccaacaagatcttttgccaccgagtttcctactccgcacgagatatactccacccaaacacaacaaccaacccaaccaacccataccgtcagtaacaccaaccacaaccaaacatcgcttgcccaaacactaaaagctagcttcaaccacacaaaacaaacaccaaatcgctccactccaaccaaacctacttttcacaatccctcccaacttaccgaatacctcaccgacaactcgtccttcacaggtaacctcgaatacaatttctccttcaaactaacttgtccatcgaaagatccaatcgacttcaagaactactctgataagttatacgaaaccctaaatgcagattctactctccaaaagatcttaatgaacactgagatcatgaccagttctctctctcctacgacaagatacctacatcttcacaacgtcaaagacgatatgaactcagatgtcatttccagaattgaagctaacgttcttcaattggaaaaaatcctccctgactacaagatccaccttcaacccagagaaactatccaaaacggagttatccttcggttcaacttcaacagtttcatccacaatgacaatgttcctgaacttatctcaactctctttacctcatatggaaacatcatcaaaacctacatcccacctgtcacctttgttgacgaggacattccaaagacagcgtacgttttgatggatcttactgctccagttctaccaccgagaagacaggtgatcaccttctctggtaagacggtccatatttccagctatgtcaactcccccctcctttactgctcctactgtcgggtcaagggtcaccacatcaagaactgccccttcaaaccaggatgcaaacactgcggccaggaccacaaactaatccaatgcaacatggctccggtccatacacttcagaacgcacttgagaaggttccaccggagtacctggctcatgtcgcatgccacacaccaccagagaggatattaccaaaatggttcatcctttacgaaaagctgttcccctcaagagcaaacggctatacgaaggagatcgaaatgaggatcaatgaattgaaatctcatgaatcggtctctgatctcccttcaatgtttaagcggcccagagtctctttgtcgcaagctacgacccccacagagtccgactctctgggtacacacattagccacacacatcagaaaataacactcgcaactgaagatgcgaatgagactacttctctgacatcagagactcaaccaaaacaaacccctgaagttacaggagatacagagaaaaccacccccgatcttcttcattacctctctgacgatgaaatggaagtagagatggtaacaggtaatacattctaatgccaaagataacactcttcaatattcagaaactctccaccccaaccaaactcaatacttttctccaccatatcagatatacccaaagtgatattatagctcttacggaatatgatgtctccaatgatatccacatccaatctaccattaactcgatactgtcaacaaacaattttactccacttgacaacgtccctacatccagggtccaaatttttgtttccaactctttccaccccactatctcgtcccaaaacacgttccagcaacacttcccaccaccttacaaccaatatgttcaggacttcaactacaccttcgaagggatcccgacctccttcatcttggtctatgtcccgacatatcaacaggaatctgctctgacccaccttactaccatcacacaaccagattttctgaacaccttcagattaatcttctcatcacatacgcccccatcaccatgcatatgcggagactggaactctgcagacaatcatagcattacggacttcttagctcgccacgactgccttgactgcttgaccaaactccctcaccatttcaccttcaaacctacgaacatctcaggagtgggtaccaacagaagactagatcgcttctacgtccacacctccatcttgaactttcaccggtttaaatacaagcttctcaaaaagcttcccttctccacccacctacctgtccttttgaatatacgaggaaaatcgagaaggaagcaacgacggacttcagccgaagccacgttcttctcatctcacacctattccgctcgtccctcccctttcccacatcacattctcgaagacaaagctctcatggaccacatcttcaaccctacccctctctggccggataacgtctccttatcggtaagctattacactgaaatgattcaagcgagacttcaaacaattaagaaactcatcagaacacttgatttcaacaaaccaacgagaagttcgctcagggaaaacctcagaagatcacactcatcgaaccctctttccaccacatacaaacagcttaatgaacgttttaaaagcaaattgaaagagacgaccttttccaactccacaattgacaaggcctatgatcttttttcttctctatacactaccgattcctccaccgataatagccttatctctcaaatcttcaacaccactttatctggtttcatggacacatctgtcactccctccgaacaccaacaactgctttctccattcacagacgatgaactcaaacgcaatctcaatctattatgtgcaaagggaccctcttcccctggtccagatggcataacctatcaggcttggagggcagcgtggcaccaggcatgcaaacacatcacagctttcgctaacgatagcctcacaatcaccggtgagatcaaacctcaacacaacatcttcaactccatcatcaaactcatcccgaagactggatttgatcctgaggatcccaacccagcgaaactccgccctatctcactaaccaacaccatcttccggctcattagctactcgctcaccaaacgttgcatgccaatcttcaataggctcatctccggacatcagcaagcattcctggaaaaacgagacatacatcttcatatccaaactgcaagaatccttgctcatcacctgaacacatctcctgccagcatcaactccatccttctcatcgacgtggaaaaggcgtttgacaagttgaaccacgaatacattcgcattgtccttcacaagtacgggtttccagcggctttcatagagtgcatcatgtaccagacaggaaccggaagtgcgcaattgctcaacggaaaatttattctcaagcgaaaaatcccgatccaatgtggcgttcgccaaggtctgccgctctcgccactccttttcaacctatgcctccaacctcttattcttcgcctgcaggcggagctcaagggcatcatcttcaaccccctccatgtcgccactacatcaacgctctatccaagtctcaccaccaccactacggttcaagcattcgccgatgaccttgctgtcttcgcccgggatgccaatgacctccaacgcaccttcaccatatgttccgacttcactaatataagtggcctctctttgaacaaagagaagactaaggtttactgccattccagagcaattccctacataacatcctctatctcggccacattcactgttacctcaatacagcaaaatcccaagtatctaggcattgaacttctctccgtggattgggagaccaaactgtcggacctcctcgaaagagcaagaaggatcaacttctgggatctccccctccatctccggacactcggcatgaacacatacatattttccaccctcttctttcacgatcaacaccaccccattccctcccaattactgaccaactttgtccaagatatcaaagaggtgatcatgaatcagatgaaaccatctctacccaagaagacagacctctggtacatccctcgtcaattaggaggcttcggcctgctagaccttcctacgcagttacaaggtaggcgagcatactacatcctctacaccctattcccatcaatctccaaatcccagcacccataccttactcagctctttcgactctccctccaagccgaggcatttgatatagagaacatgacaacgatcaatgcaagcctcatgtcccttatagcagaacacaatcgtgataacaagccggaggtccacattccccccaattttacatcccactccaccatcactctcgaacccaacattgccatcaccccatggttttcccgcatcgtcaatcctgattcatccttgcctcggaacctacattattccatgggcgctcgccatctcaagttcaactattctcaactcttcagaaatgaccgacgagaagaagaagcgactcgccgacagcagctggaagcctcctacctggagcgaaatcttcttccaccagcactgggttcatactacgcaccgcttgacctttcacttccaacggaccagatcgtctccgtgatgcttccaccgccaccaccaccagcatatccaaaccttgctcaatacatcatatcatggcaaaaggttgtgaataatatcacgacaaacacctcgctctcatacagggtcatacagctcttttccgacaacgacccagagctccttccactttcgagctttgcacttcaaaaacaattcagaacagaagaactatgcaccatcacaacgtccgaagacttaaatcacttgtctaaaaagctccactggaagacatcaaacattctcataacctcccgaacctggatcgaccacggcttctcaattcaccgatggaagaaattctacaaaagccttactggaatgatatactcgaatcccaagaagtattatttcctatatgcacttaacgctggcttattgaataatagattttacacctcgtgcccttgtgagcatgttgaacccacaacacaatctcccatccgccatgtactcaacgattgcaggattactaacagtctgtgggagtttctccatgatgattcaccacggccaaacctcatctgtcctgaacttaatacaccgactatgattcagcttaatcattttgtcggatatcttttttacgcacaccaaatgagttatagcagatccatcaatcatgaggatcccatagactggtctgatgaggatgaacttgctctccttcatcaccactacacaagccgctatccggacgactaaatctcctgacaaaaccataataattaagggtttttgagataattatctctttcccacttccaacttaagaaccttggcctcttaatgtgcctatagtaatcacatttgacataatattttttctttccttttgacagatggcttctatttttatactcattgttatgacttttcgtttgtaaattaagttattaaaaatcgatgatcatcttaccatagaatgactaactaaaaagaactaccatatcgatcaagcgtgctgtcaaagttccaagggcagttaacattttctaagtgatgatgatgcttttattgattcctaacaatgttatcggattaaaaaaaacaatattgtgatcgtaagctaattcgactatccctgatgaattgttttagattcaagcaaaaacgacagctatcttgtgaccaaataagaatattaatcgtccagaacactttttcaattatagtatataaacactttaccatacacagtaaaaatcaaactattagggacatcacacgattattaaagatcagtcaaaataggaaataatttaaaatatcctttttcatgatctttcacctgtcttagattttagaagtatcacttggtttctcaattaacttaaaccgtcgctgctgtgtgcgtttactaatccccgtttttcgttcaatcatcttgtaggtcatgccttgttttcgcagctcataagcaaatctgatttgttcatcagaatacgttttcggtcgcccttcccgaaacaacggatcatgttgcttggcatacaatttaccttcttgtgtgcgcgtgacaatcatatcgcgttcaaactgcgcaaaggcgctaaatattgtaaagactaattggccagtcggcgtattgtcaattaagcccatattcaaaatgttgactttgacattttctttaaacaactcttggataatggctaatgcctcgcgcgtgttccgcgcaaaccgatccagcttagtgacaatcaaagtatcgcctgtttttagaacgcgcaacagtttttgaaactccggtcgttcagtagttgtgccggtaaacttttcctgaaagattttttctgctcctgccaattttagtaactcaatttgatttgctaatttttgatcagtggtactgacccgcgcatagccatatttcatctttttatctccttacttatgtcattaagtaatgacacggttctaaccctttaattatacagtatcaaaaaagaggccacaactgttaagttgtggcctggctagttctattaattataaaatttgttagtaaacaatcaaaaatcattgtgaagtgaacctaatttattttgtacgaacagcattcagattaattttacaatctaaccgataacgatttaaattttatcgtcagtgttgctgacaacactgcatcctgttgcccgaaacacccttgaccgttgttggcaacacccaacactgttgcacacaacagtcacttttatgactgctgccggcgtgctttgatcaactcacgcggcggaaaccaggcgtattgcgcccgttcagtcgcctcatggatcgtactgcaacactcatctgttgcgatataacaaacatcttcatcgtgattagcgaagataaactgccgaatctgccatgccgaccacagtggtagccttaatccaggtatctccggcaagttagccggaacaactaagtcaacatgactactaggcagccactgttcgatcgcccattgcgtcaactggtgcgtataaatcagcattgcgcgcacctgcgccaacttcttaagtaacttccgcttgcagatatgcacccgaacaatcacttgccgttgtgtttgcggctgcgtaaaagtcacaaaggttgccttactagtagtataaatcgaatcgtaccagcgactgccgatccatgaagtttgcccccagctaggtgtgctctccggtacaaacgaattctcccccgcaaaataaagcggcttccagcccaatctacgtgctacccaatgccaaaatcgcggactcgttaatgaccgctcactatactcgctgatcaaatcgttagacttacaagtggtcaagatgcaacgcccattgatcccgatcatagccgtatagtatcgcttaccttccatattaaccgcatgcgctaagctagcgacataaaccgtatcaggtcttatcacaaattcatcactcaactcaaccagatctaaccgcgattcgatctgctccaaatcaaaatacggtacgtcgtcgttaataaacttgggttttcgaactaacattttttaacccctttaaatatcgacgataataattagctacattaatagcataaacgacaaaggtaaaccagtgcatgaggaagcacttattttttaataaaaatattattaagcttacattaaaaaagctaagttagcaccaccaaaggcttttgcatcaagaaagcgttttatttttattcgtaaattcgccttttttgtcgtttgcgtactgcgggggttgatcagtatgcttatagcgtcctagacgtctgggatcactacagaaaaggttgtgatccaatgacaaatcaattgatcaacaccgcatttaacgctgcacttgccgataaaaagctgattttcggcgtcttaaaaaaactcaacatcacccgacagaatcctgattttgacgactattttcaagaatgcatcctggcttatgtcgacgcgtattgccgctatgccgaaaatagcgccagccttgatcgccacacttatctctacatcaaactgcgccaacgcgtgattgacttactacgcaaacacgactgttaccaacgctacttcggccacaccgcgcccgatgaccgcagtagcgacaccgaacacagtctataccaagcactactcttgcagcaactactaactgaactcccgctaaccgaaaaccaattattccgcctactttacctgcaagatgactcgatcaccgagatctgccaacaattaaaaattagtcgccgcaccgtttaccgccgccgaactaagttattggcaaagttacagcaattattgtaacgattgatttcagttaccatgttctcaaccaatctagactaaacgcgcctaaaaaagcagattactgcgcctttttagataccctgtagaaaaagggtggcacaaatcggcacgctcatacggcatctataagtgaagggtaaaatagcggccgctgattttccccccttcaaaaactggcgcctatcactaagttactcattaacgatagagtagcgcagccataaacttaaggaggtcatcccatggctattttgaaaacagacttgcagatcaaaaccgtcggcgacaacatcgacggcgaagcgacgcacaagttcgtcaacgtcaaagaaggcaccacccctgaacaactggacacattcggtaagaccatcgctgaactagccgacgaaggctacagcgctgccgtaactgttatttacgatcgccacgactacgcaggttagagtgcgttgaaaaagcgctcagattatggcctatagcctagctggacgataagagacacgcaagtagctcgttcgaacagcgtagctatacggaataagctgttttttcgatcacgtttcggctagagtgataaattaggcgctcaggatttgagcatcagcctactactccacaaaagtagttgattattagcaaaaaccgctaataatttttgatgttacgggcgttgaccattcttgtggcaaaattcgtgccgcaagaaacatggcagttgggtgataagagacacgtagtgactcgttcacacaacgtagctagtcgcagaaacctgcaccatttagcatgtttccaccacccttgagtaacgcgcaccaccctcattttcgccgccaagcgtacgccccaacgccaaattgcggaaatgccgcaccactaaattatctactactacacccaatccaccacagagaggagcattcccatgaaacaacttgatatggagttcaagaacgaaatcggcaaaacgaaacacatgcgcctgaattacgcttcccagaccttggacgaaaccacggtcaaaacagcgatgcaaaccatcgccgatttgaagatgtttgagttggaagctgttaatccgtacgcaacgccgatcaaggcgcagtatattgaacggacagtaacaccaatttttggcggtgaagcagaggctgtagaaccagtagccgacgctgaataaacaccgaatacgccaaacagccacactcaatcaaaagtgtggctgtttggcgttatttcatttcaatttaataattcgtaatactatcgatcgcacgttgccgtaataattcgatcattgccgaactaacatccatgactacttgatcagcacccacaaattatcaggccaacgactatcctgtctacttatgatcggcatcataataatcaacgctgatccttgaccatcagattctccctcaccccagcaatgctagcaaagactcctgttcaatcgccagtgtttccggtatctgctgccaaaaagtctgcgcagaacgttcaaaattaagcagatctagctcgttaattaataatacagcctgatttgtatagaccgacgtgaagacatccagatgactactgagactattaccagaaaagtccaatgggtcagcttgactacgaaaaaaatcgggtcgtaattgctgcaatttttggacagcacgctcattacctgacttaatagtttcagccaagtaataaagctgctgcatctcagcaacattcattgttttagccacatcagcggatagaaacatcccaaaaagtcgcacgacggttcgataatttagattctggctaggtaattgctgccgcttcaagttatcttgcaaaaaagtatatatctgattacgccattgttgggctaacatcaaaatgtgggtataaagatgcatcattatctcactatctactaaattaaccggatattgttctgctagcgttggctggtcaatcttggttttaaaataaagtcgcgtaacttctgttagctgcgcacaataatcatctttctgatcgacccaaaaataaaattttaccgtctccatatcgctaatccccatactcaatatagtcactttattagcagtgaaatactcatttctaaacgtaaagttattctaataatacacaatgtataggtaatttacaaaataaatttagctttttgatatttaattaaagtaaggtcgcatatcaccttgatagcaataaaaccaccactacataacacgaccaatttgagctattatcagcgctagaacggatacgcgctcaagatgagcatgtaaaacaggctaaaaagtatacaggcgattgggtgatagatgttaaaaggggctagacgactggtgcgtggtgtcagaacgtgggctagacgactggtgcgtggtgtcagaacgtgggctagacgactggtgcgtggtttcagaacgtcggctagacgactggtgttgaggatgagtgttctgcgaggataaggttggtactggcatgccggcatcttgtgtgacgttaccggatggtgctatcagtggcgtgttgttgactgtgaatgtcttcgtcggtagtgtgtcgctggcgaggcgtagtggctggttctgatggagttgaaacgtgcctaatggtgtgtaatccgtgatgagttgttcccggtgtttcagatcgtgcactaaaagtttgtagtcgttgtcgtggccaacaaagtaacctgcgtgtacagttagcttagttcctggtttgaggtagtagaagacatcctcgaggaacattggaagtgtagggagtgtgtatgcttgtccgttgaagaggcgggctggttgagttgctgtgtaagcgtccttaagagtctgttgttcggcggatagtgctccagtaacccgtttgtaataaagaccgtgtggttgttggttgtcaatactcgagtgcggtaggcggttgtagatcgtggtggtgtattgatatgactgtacaaagtagcgcttagcggttttcttagcaatatgggcggttatgagcatgtgcaatagtttcagtgtttgaacagctcgttcagctgtgccgttccattgcttaagacctgttggggcgaaatcgaggtgtggttgacggttgaatcagtaaagcgttcgggtctgtcgtgttgttaacttcaggtactaggtaaccaagacctgcacattcggttcatttatcaatggtgatcttgcgtgttgcacggttatgttggagttgttgggtacgtgaccagttattgacgaggtgtttgatttctgcattgtagtgagcgtatgggtgtatctgctgtattgatccacgataatgactgcgtaccgttttgagtcgccatagatgtacggtccggtgtgcatcattgtctgtgattggtatcttcagcgttctcgtgtttgctagacttatgtgtccaagtgcgcaatgtaatcgaagcgttgtattgaggggaacctgtgacatttggaggttaaacttgtccacgtttaccagcatgagtttctatgttttgttagcctcacagtggacatttctatggtgcggctggagtttgtctgatgcatccacgtcaattttgtagatgttctccaccttttgtatagtgatgatatgtttcttccagttcttcgataggttgatcatcagttgtttcagttcttcgtgtagtgtgagagcaggtggtattatgagtaccttgtcatctgcaaaaatcgcggtgtatcccagggaagtcaattgagacacacttaacaggtacgaactgttaggatccatttccatgcattgaactgtcatcccatcgatttccactgtgccgagcttgatatctgtggcaccggtgccgttggctatgttgactttagcatgcactgtagaattctgttgtttcttatgtttgttcgtgcagaaggatgtgactgtcttcgatgcgccagagtcgatgatgtatgtctctctggtttctggtccaagtacagtttcattgatagtgttttgggagttaggttcactatataaaactatacctggatgttcctattaaggggtaattgttgtagggaatgttgtttgttgctgaacatttggttgaccagcatattctggtttagtgtaggcatatgcactgtggttcctgcaacttttattctcggagaggactgaatagtagtgttgttgtaaaacacgttagcagctgttatgtcctcagttgatttgatgattggactcttcctgtctgcttcactgaacgcttcgaagagttttttgtagtcgatcggttctttcttcaggtattgtttgtttatgtgcttccaaaagatgtgttcattgttggatttattcggtaggaggccgactgcttttccatacactttaggtaagtccattttcatgaggatggtatcgagggaggtttctatcataccatatattctgtttttcaaggttccatcggtgatgatgtctttgttgctgtctttgatctttatcaaatctgcccttaaatcgtttgacgttaaatcttcaatcttgtctagcttcataatactccacacgacggagtagaatgtgttgttcgtccttgtctagctttcaaagagctcctttgtcaaggtgaaccattcgcctaagttcattttgattgttggtttcttctccttctccatactgttgatggcgtctcaccaaacatcaaaagtacgtgttttcggctctagttctttggcggtcatagacgttgtgtttgccatttttgccttgtagtttattaagtgaaaaatgtcctagctctggtttgctttcggcttttaacttgttatgtgttaacagattaaaggggggagagacggctatgatttgtatgctacaataagacatctatagagtcgtcataatataggtgagctgtgaggctccctccaggcaagtccactgttgtatggaacgttccccagcctgtgctagaggcggagtgcctaggggcaagctgcccggccggcggatgctatccccgacccgtaggcagcctcaacatgccgtgaggttggcgctgaccgtgtagccatgttactggtgcacgggtcaactggtggactccggagctaaccggaggtaacaggataagtaggcggattgaccgctaacacaagggggggggaagaaaaatgtaagctctgtgagttagcattttgttaatattgaagtttgctataatgagattgatgaagtggtggtagttttacaactagtctggtggaaatggaatgcttgattaagatctgtggtttgaaatagctgttgtagtttggtgtatccaagggttttggttagtaactctgctggtttgtgttcaccgcggacatgttgaagatggaagatgccgcggttgagcagtgctcggagcttgtggtaagcattaagaagggccagttctttgacatcgggtctgaggtgaattccgttgatgctatcagctacgggactgttatcgcagtgtgcatcccgtgttaataatgggacattgaagtcttgtagtctgagggcgacttggtaagctgtttctgttcctttttggagtgcaatgagttctgcatgatagctgcaatatgttggatggttgatccgacaactgttcgatgccactacctatcgctaaggaggataatgtatccaccttgacttgtgtgtggtaagtgtgatgcgtctgtagaaaccttgagagtatgagtggtggtgtttgtcagcgatgtgagatgacggttcgttcttgggtagacgtatgtgcgcatgacttggggtgcatgaaagtaatggtaggttgtatgctggtgtattgagtcaacctgttcgcgtgaacctgtatatcgaagcgagcattctgggcaacgtaaatgagtatgccgatgacttgtggataagcctgaagactgaaggtactatgggggaagtatgtatgctgtgcgtagaatgccgagtggtctgtagactgatgtatatccattacgatccgttctagtgcagtgtatcgacctttaggatcgtgaatggtttgtgtgttttgtagagtgaaccgaatatactcgtggcggttccggtctattgtatgcggtgcgacggtggaagatatatccatctctgtgatatcgagtgtgaggtgtccaatgctgggataatagccacccgggacgtagtggggattttcgtgtacaaaacttggataatatgctgtgaccgtggttgtatttgattgaggatgttccacatgttgtggggttaagaccgctggtcgtgttgttggtatggtggcgtagtgctgaactaacggtgagaaaggatcggtcatctgttcgatgtatgtagagacgctgacgaaaagtgtgtcattgatggtggtcactacccagattgtaggcaagctcgtgactgatcttgagctggaaatgtaatttggagttgtttgatttgtgctagtgtcccgatggccagcaaatgataatcatgttctgtaacgaagagttcactggtgggcgtcagatgaagacagttatcgaaggacgaatcgtaaagttgctggtgttagaccgagtctagagtcttgtggaactctaatggtgatgtattgagtccatatgcgtacttgcgaagcctgacctaagatgtgttgaactgtattggtgtcttttgttcgtgtgcgtacctgctagtctagcaggagtttggaggtagaagaagtcagtatcagaaactggtgcttgaaggaatgatgttgacacatcatggagtgccatgttcaaggatgtggtgtgtgcgtacctgctagtctagcaggagtttggaggtagaggaggtcagtatcagaaactggtgcttgaaggaatgatgttaacacatcatggagtgccgtgttcaaggatgtgttgtgtgggtactgtgtgtacatcagaatactagagtgtgcttctgccacaggactgctgacctgtttgttcttgtgtcctacccgatcacgattgaaagtgattaatcgggctttcggagttgtcgggcttcctttcagggaacagccaaaatgtatgtaggtgtattgtctctggtgggatcgtgtttgtatcactgagttcgaagacttcaagattgatgacaccttggagttcttcgtgtgctgcaggttgccattttgcatcatccatttctgcttccatagttttaggcgtacctgcgtgttgtgttgatgccgtatgtgcgcgatgtgccgcaaccgatagatcagagtcggttatcaggtctgtggattgtaggaatgggctaaggtatcggtccgattggccggaagtgatgtcggcagagagtgcaaggcctgtgtagagatcatcaagcgtcgagaatgtctcagttgtctcagtactagaatcgttttgatcgtggtctatgtgtgtgtgctgggtgttagcgtatgggttgtccatattttggagagtggtagttcgatggttaagcgtctggtttgacttgtcagaacgtcgactagacgactggtgcggagtttcagaacgtcgactagacgactggcgtgtggttattcttctttagtaaataaaatgtaatttgtaaattttcattcagatggtagactaggtaagtaagctttaaccaatttgggagtgattatttatgaaaattaaatcaaacgatttattagaaacaattcgcgatgagaattttgcaccggaaacttttaaagtcacgagcacaaagttaaaaaaagatcccaaaggggcattaaaatctgtttttggctatctacaaacggctttgaaagaaacagctgttgtggaagccgacgtggcaatcagaaaagatgttgttttgaagtttcagaccaatatcattaacttaccatttaattatccaaacaagattgaacaactgactgaagttgatacggattatgatgttaatttatatgcgatttttgaagcagaagagattaatgcatcccacttgcggattgatttaatgggaagtgttgataatttcttagcaggtgatgcagatgtttatcaaaacatcgctgattgggtgatcttgcaatttgagaaattagaaactaagaaagaaaaataaagtagaggttgtttatgaatcatttaactaaaatgttagcagtagctggagttttgtttttggctgtctttttaattagcttacgattccatccggccactagcaaagtaaaaacgcaagattcaaatcaggtaagtgtttcaaaactgcctaaagagaagaagactaaaaagaaaaaagttgccaaaagaccgtcttacatgcgagcggtaaattggaaaaaatcttcagaaacaaaggcttacccggatttaacgaaatactcaaacgtatggattcaggtctcaattgcaaaacaacgggtctatattcgcaataacaaaaagcgtttgtataccatgtatgcaacgactggtgctaaaaactcaacgcccaccggaacgtaccatattcaggcagaacgtggtgagtttttctataatgcacagtctaaagaaggcgccaagtactatgtttcttggaaagaccacggtgtttacttatttcacactgtgccaacaaattcacaggggcagtttattgtaaaggaagctaagaaactaggtaaaaaggccaattcacatggctgtgtccggttgtcggtaccagatgcaaaatggatttatacaaacattaaagaaggaacaaaggttgttatccactgagggaatagaacatgaaaaacaaaattcgcgagtttctactgcaaaaacgaaaatggtatcaagatgctggcattagtgtggccagccttttcgtggcccttgttttatataagttaattggttacatcttcacgaagatcaactttttgaattgggaaacaattatcggtgttgtgattttgtatgtcatcattttatttgggtggcgttattgggagctcaattggtcacgcaaacgataaatagattaaaaaaaccgttaatttctagttggaaactaaaaattgacggtttttgtgttgattaattttaaaatgaatgatggaattccacgttaagccctcgaaacgagtttatataactgtcttgctataacaggtaaaattgctaacgtaaagaagattaaagtgaaatacctttttacaaaggtcgttgtgcctagataatatccagctaaacaacaggcaccgacccaaatgagagcgcctagaaaatttagtttgttgaacctttggaaactcatatcagagttgccggcaataattgggacaaacaaaccaaggaacgggacaaatcgagataataataaagaacttttttcattgtgattaaaataagcctgtgttttttccatttgatccgaagtttgaatttctttagttagtttggagtgttgaccaagttttttaccttgacgaaatttgacaactgaaccaatagtggcagccgttagaaatacaacaaataaaacaattaaattcagtttagaatgtgggctggcggcaattgtacttgttaaaaatagaactgattgaccaggtagaaatgaaaaaatgacgtaagctgtttctaaaaaaatccagataaataagattaggtaaatccatccgttcattttgtctgcgattggcacaatgtaatttagtggatggataaagaaattaatgattaaatttagcatagcggaactccattcccgtaaaaactaccctaatcatataatgaaatcgtgaaattgactagtattgggattggtaattgaaagttaaacgtgttatcatgaatttatgcgatgagtcgagtataatcaggcaacttaggttgtttcactttcgagtgactagtgattttcttggaacgggatgtgtctcttccaccggattgtgtggaacatctgattaaacatgtgtgaaccgtgcgaggtctatttgagaaatcaagtaccgttcaaaaaaggttgaagcaattttgcttcaaccttttttattacgcaattttattgaacaatataaagttgatcatgaaccaaatcaaaatgagaaaaatgtttgttgagctcttcagtagcctcagggtccacataagtggcatggttccagaaagttttgcttccagaacttcccagcttttcgccaatacaaattaatttaacatctgggttagtttttcgcatctcttgtaagagttgccaatcaacagggatgccgtctggtgaccaagacatcatgacatatttcactttgtcatggtagcgatgccaagcatccagtgcatctaaaggctcgatttcagtcaaagtatgtttgccagtttcgttttcggtgatccatcccatactgtcggttgcaataatgttttgaccatgattacgtaagccggctgaaatgtagccattgcctgccatcacttccaaagttggggcaccatttaagaatttggccagatctttgataaaaggcgctgaaatgtacgcccacattccgtaatgcgcctctaaataatcccgataagatcgtagcaacttatctaacttcggtaatgcttgcgagtacctattccatagttcatcgcccttaggatttcccattggataatctttaagaatagactgaaacagttcatcttgaaaagtatctggaatttgaagaagaggcaatgattgtggcaacaatccctgagaaataagatgatcactttccaaaatgttatgggtaaggaaagtgatctgagggaaatctttgaataacaaatcgtatctttttatttgctctaaataagtgtctgaagcgggttttgaacgtttagcacgaacctgcttacgaagctttttcatttttttagaattcaaaatagccatccattcaaactgtcaagtttactttttattgtcatccaagcctaaatctaattcttcttgctgatcattatctgcatgaatggttcggcgattcttgccatggaggtagccatccattaactgaaatagttcatagcgatcttcactcgtcaaaaccttatgactgaaggaaagttgtttaccagacaagaatagtttactcagatcatattcatcgtgatcggccttaccactaagataatccatcgtaacatcaaaatattcggctaattttcgaacctctacaaaagaaggggttcgaacgccacgttcccaattaccaatctgagaggatgtatttgctttttctgctggtcctggatattgtttatttaaatccgccgctaattcttccaaagtgatgttttggccatggcggagtgcacgaagtctttcaggaaacatgtgattactccctttctgttatctcaattttatcataacaacagcctgttaggcgcattctatcactattttttgcattttagtgggacaattcgaacaatttgtcacaatcgcgatccaaattatatgaaaccggatagatagtgaatttcatgggcttgattgtgatttatttggcctttgagaataaattaaattcgtttgcgcttattttactggccaaaaaagcagtatactttttaaatcgaaggataagggatgaaaattttgaaaaagttttggaaatggttactcgttatttttgcagtcttagttgtagcagatattggtgcggcttcgtatttttatcatgtggttgtggtacctggacacaaagattttttaagtagctcggcaatcttaaagaaaagtgacccactgtataaagaaaagctctggtatcaaaatgtccataagcaaacgtggcatgaaacttcggcaacggataatctcaaattagatgcttattatattccagcggcgcataagagtaataaaacggttgtaattgcgcatggctttatggatgataagtccaaaatgggagcttctgcggcgatgtttcataagatgggttataacgtgttagtgccggatgaccgtggccaaggtgatagccaaggaaattatatcgggtttggttggccagaccggctagactatattaaatggatgaatctattgttgaaacgagaaggtaagaatcagcagctcgtgatgtatggcgtgagcatgggtggtgccacaacaatgatggtcagtggcgaaaaaaatgtaccaaaacaactcaaggcctatgttgaagattgtggctacacttctgtaaatgatgaaataacgtatgaagctaaaactatgtatcatttaccatattggccattagttccatctgtgagtgcgattacgcagttacgggctggatataactttaaagaggccagtgctttgaaacaggttgcgaagaatcataaaccgatgctgttcattcacgggaacaaggatacttttgtcccaaccagaatggtttacccattgtataaagcagataagggatctaaacagctgctcattgtgaagggtgctacccatgcaaaatcaatggcgacagcccccaaactttatcaacaaacagtgaaaaagtttttgaacaagtatgtgaagtagtgtgtttcttattaaatatattttagaagtaattaaaaagaacaagagactggcaaaagtaattttgccagtctcttgttcttttacagtcaaactttttagctaaacggaggaatctaaccgctttttcccattcttttgctttaatcaaaaggttaaaactataaaaacacgtctcgttacctgatacaaaagcagtcatggtaacgaaattagattaaaataccgtctctcagtgcctctccgccaggagaccaccggaatgcgccccgttcaattacagccccaacaccaacaagatcttttgccaccgagtttcctactccgcatgagatctacccttctcacacacaacaaccatcacctcacacccccaccgtccccaacaccagccaccactcaacaactctagcccaaacgcttagagccagcttcaaccacccaaaactaccaaagaaccgcactcatcacaacaaaccttcgttccacaacccctccgagctaacagaatacctagctaacaataaacaattcaccgacaatgatagatacaacgtatctttcaaactcaacctaccagatgactcatctgaaacctttaagtctttcaccaaaacgctcatatcagcatttcagcaagacaatcttcttgcggatattgcctcagatattgaattcatttccactaaactcactgcatcttctagatacatccaccttcatcaacacaccaaccagatgtccgatgacatcgtatctaaaattgaagccaacctaattcaactcaatagggattcggaagaatacaccatccacgtccaaccaaaacagaccatcaccaatggtacgatcctccttcttaacatcccgagctctgtccacaatagacacatccaagaactagcgacagagatttatcgaccatatggagatgtcatcaaagtcatcccacctgaaggtcaattcttcgacgaagatgagccaaaacaagtccatgttctagtggacttgaaatcaccaacagtaccaccgaagaaacaaaaaatctggttccaggaccaacagataaaggtacaaacactaataaactccaagctgttctactgcgcatactgcaggttgcaaggacatcatatcacccaatgtccattgcgtaacacgtgcccttcctgtcacgccgatcatcagctctatcgctgcccatctgctagttcctacgcaatcaaaaaaggaatggctatgatcccacaatcatatgtggaccaagtcatggcatcaaccccaccggaaaacctcttgccccagtggataatgacatatgaagaagctcttcctgaacggtccaagggctactcaatggaggtccaggagagatatgaatttttccaccaagagctgaacgaacctccatacccacatgactacacccccaacaatgacacggaacctagttacacgccaatgacacaaaaccaaccattcaatggtctgcaggatcactccatcaatcccgaagatactccccaagacaataatgggttccaagctcccagatccaccttcaaccctacctcagaccaaccacaaccacaacaaactccacaaactaacccattcgaaagcttaacaaaggatacatcagatgactatgacccttaccaatccctaccggatgaagatatggacctagaagataattagacatgcccaagatcattatatttaacattcagaaactcaccacaatcaacaaactctcctcattcttcaaccatattcagcaacaagatccagacataattggcttcactgaatatgactccccaccaaacgaaagtcttcaacaatcaatcaccgcactactccaatcccaaaatttcactgcccttccaagcttacccaaatcccgagtccacatagtggtcaaatcaaccttcttatcgtccataacatcgcaaaacacgtttcggcaacactttccaccgccatacaactgctacttacaagatttcaatttcactttcgatggcacaccaaccagcttcatattagtttatattccttctttcagaaaccatttacagacgacaacactgacgaccatcacccaacaagaattccttgaggtctttgaatccaatcttcgtcaacacacccccatttccccatgcttcgccggtgactggaacactgcaccaacatacccaattttcactgaacttgccttactgggatgcaaagactgcaccaccaaattacccccatcctacgccaagaaaccaaccaacatctcagccacgggcgaaaaccgcagacttgacagattttacatacacaacgatgtcctcggatttcacacaatcaaatatcgcgtcctcaacaagctcccattctcaacacatcatcctgtaatgctcaacattagaactagagctagaaggaaacaacgcaacaccactggggaaaatgtgatattctcctcctcatcctacacacaacgacagccacctttccctcatcatatcatccaggaccatgaattgatggccagcatatttaagcccacccctctatgggcggacaacatatccctgtcattctcctattactccgaaatgatcaactcacgcctacaaaagatcaaacaaatgatccgacaagtagcacactacaacccaacaagagaagcacttcgagcaaactacagacagtcacacagtgccaacctactatcaacaacgtataaagagctaaacaaaaggtttaaatccaaacttgctcaaaccaccttctctgccgcaaccatagacagggcgtacgatcttttcagttccatctacgaaaagaatgcagcccttgagaccaccgatatctccaatctttttactgcatccttctcaagtcacatcacgaaatcactaacaactgctgagtgcaatcaattgatacagccatttcaatctgaggagatcttagctaacctcaaacttctttgctctaaagggccgtcctctccaggacctgatggcataacgtaccaagcctggtcggaagcatggccatacgcagccacacatatcacatcttttgctaaccacaccctaagcggtcccacaactacgacactcccctatcacaatattttcgattccctgatcaagcttatacccaaaaaagattttgatcctaacaaccccaacccgaagcacttgagaccaatctctctcaccaacagcatcttccgccttatcagcttctccatcacagtacgaattatgccaattctcaatcgagtcatctccccccaccaacaagccttccttcagcagcgagacatgcacctccacattcaaaccgctaagttcttggctcaccagctcaacacacaccccagcaatctcaactccatcctgcttctagacattgaaaaagcatttgattccctcagccatgattacatctccatcattcttcaaaaatatggaatcccggactcactcatccgttcaatccaataccaaacgggcgttggtcaagctagactacttaatggcaaacacgttttcaagaagcgcatcactatcaatagaggagttagacaagggctacctctctctccactcattttcaatctatgccttgaacctttgattctgaagctacaacatcaactccgtgggataatatataacccgctacacgtcgaaaccactcatcaactacatcatcaactcactatcaccaccacaattcaagcatttgctgatgacctagccatctttgcaaaggatcagaaggatatcaaagaatgcctccaaatcgctcacaccttcaaacagatcagtggtctacacttaaatgaaaaaaaaacaaaaatctattgccatcaaaacaacgtcattcaacttcaggaatccctccgtacacctatcagcattacatcaatcttggaaaatcccgtatacctcggtgttccactcctccactttgactgggaatcaaaactagaaacgttggttgcgaaaactaaacgaattctcatcctagatctccccatacaccttagaacactaggcattaatacctacatatactccaccatatttttccaggatcaacactcacccatcccagctcaactgcttcaacgattcatcacatcgattaaacaacttctttcgtcccacatctatccatcattccaactctccagaaacttatggtacacaccaagacaattaggcggtctaggtttgctcgacctaccaacccaactcctaggtcgaagagcctacttcaccttctacacactatttccggatctatcggcctcctgccaccccacccttcatcggctctacaggttgtcactacaagcacatatgtatcacaaacaaaatctccacaacatccaacgacaaatctttgaagtgatgcaacaacacatctctaatcgtcgccaaatctttacgattccaaccaccttcctacaggaacatcgcatcccaatcaactccaacactccactcattccctggtaccagccattcatccaagagcacaatttcccctcgatcccattcaaatgttctgtttccacaatgaacggaacactgacactcaactactcccaacattatagaaatgaactacacgacgtgattcttgaagaacatatgcgaatcgaacaatactatctccaacatcaacaaatcccaccacccatggagccatatggagccccagcagatctgactcttccatcagatcaaattattgcgatccccataccaaccccacaaccactatttgctaatgtccttcactacttacgtgcatggcaaaaaataactcaacgaaactctcaacctgttgaactgtcagccactccactttcaacactagcaaatccacttcgcccatcaaactttcaattacaggatcaattttctgaaaataacaccccgatacctctcacaactgccgatgacttaaaccatctttcaatgaagctacattggcaaaaacttgaacttctcaaagcatcgtacacatggcgacacgtatccattgaaaaccaacagtggtctcaattcttcaaagtaatgtcgtcacaaattttctgcaatccgaaccactactattggctctatgcccttaatgcgggatatttgaacaacactttctacaaaccgtgtctctgtggactagcactgacagcagagtctcctattaaacatgtatttcatcactgtactgcatccacctccatttggaactttctctatccaggtcagctttaccccagagtgatatgccctactagtctgaacatgcaggccatacaacaactacataacttcattggctttacttttcatctacataggacaaattatgccagagttcacaatggctaaccactatatatagaaaaaggacgatgattagttacggaaaccataaatattctctacatcagtttgagtggcaacacgaaatattttattagcagactgacaacatactttgagaaagaacgtcatgttcgggttagttcaattaatgttaaagaacaccctgaattcaccactcttgaccagccgtttgttaccttcctaccagcctttcttaaaggtggtaatggggctaataacggttatactgaaatattaaccactattttgggagattacctcgcgtacgaaggcaattaccagcattgctacggtattatcggtagcggtaatcgtaattttaataagcagtttgcactcacggctaaacaatatgctaaacgcttcgattttccttacattaccgattttgagctacgtggcaccgcacacgacattcctcgcattgccgatgccatcttaacctatcgcaatcaattttgttttcaaacaacgaaggagtaatccctaatggtaactagcacccccaaaatggaaaatacctatttttacttaaataacctcgtaaatatcccaagcaacggagaaattccgctacattatgatcaagaagccctaaaggcttatttcgaagagacagttaaaccgaagaccaagcaatttgattcgttaaatgccaagttaaattacttggttgacaaagattatatcgatccaagtatcctggaacaatactctcacaagtttgtgcagtccttgttcgaccaaatgagagaccatcactttcgttttcgcagctttctcggtgcctacaagttctacacacaatatgccatgaaaactaatgatggccagcaatttttggaagactttgtcgatcgcgtcgtcttcaatgccctctatctcgctaatggtgatgaacaacttgccaatgacgttgccgatgaattgatttcacaacgttatcagcctgccacccccacgtttctcaacgcgggtaaaaaacggcgcggtgaaatggtatcatgttttttaatcgatgtggccgactccatgctctcaattggacgcggcgttaattctgcccttcaactatctcgaatcggtgggggcgtcggcgttaacctgtcaaacttgcgcgcctcaggtgatcctattaagcagatttccaacgcctcgtctggcgttgtaccagtgatgaagttacttgaagactcatttagctacagtaaccaacttgggcaacggaacggcgccggagtggtttatctcaacgtcttccatcctgacatcttacattttctggataccaaaaaggaaaatgcggacgaaaaaattcgggtgaagaccttgtccctcggtttgattgttcctgataaatattatgaattactcaagactaacgaaccaatgtatctttttagcccctatgatgtcgaacgtgaatatcgtacgccatttgcttacatcgatatcaccaaagaatataacaacatggtcgctaaccccaatattaagaagtcagtttttaacgcgcggaaactagaacaaaagatttctcaactccaacaagaatctggttatccttacatcttgaacattgatacggccaaccaaactaaccctgtcgatggcaaaattattatgagtaacctttgtagtgagatcttacagcctcaagaaccgtcaaaacttgatgatgacctatcgtacaagacaattggcaccgatatttcatgtaatctcggatcaactaatatcatgaatatgattgactcgccggacttcggtcactcagttgaggttgctgttcgtgcgctcaccctcgtaactgacacaaccgacgttaaggaagtaccgactgttaaacatggtaacgaactttaccacacgattggattaggggctatgggtctgcatactgcccttgcacgccaccaaattgagtatggctcaccagaggcccttgaatttactgatgcctacttcctagctttaaactactattcactcgttacgagcaatcgaattgcccgtgaacgccacgaaaccttcgctaaatttgaccaatcaaagtacgctgatggcagttacttcgatcaatacttgaacgcagactttgaattcaagagtaccaaagttgcaaaaatcttcaaaaatattaaattaccatctgttacagattggaaggcactcaagcaagctgtgattactggcggcctttatcatcgtaatagactcgctgtggcaccgaacgggtcaatttcatacgtcaatgaaacaagtgcatcacttcatccaatcacacaattagtagaacaacgtcaggaaaataaggtaggctcaatcttctatccagcaccttacctgtctaacgaaactttgccttactacacacccgcatatgatattgatcaacgaaaaattattgacacctatgccgtagctcaaaagcacattgatcaaggcatgagtctgacactatttatgcgttcagttttgaaacctgacctttacgagtggaaggacaataacaatttaaagatgacaacccgagaccttaaccggttacggaattacgcctggacaaaaggcattaagtcactttattacattcgaacgtttacagaagacgatgaaattaaaacggcaaatgaatgtgaatcatgcatgatctaggaaattcacttggggtcttaccgtccgtttaacacaccggcatacgttattgggtcacaagacccatatacccatgaatcctaattaaggagacgaacaaataacgatggactatttatactacaaagcaattaactgggatgatattaaagataatttcgataaatacatgtgggaacgactcaccactaacttttggttggacattcggattcccatcacgaatgatcaaacggcttggcaacagctatcagatactcaacaacaggccattactcgtatgttggcaggtacatcaatgttagccgtctaccaatcagaagttggcacccctgctattcgccacgatcggcgaactcaacaagaagaatccgtattaaacaccattacctttatgaaatcagtccatgccaaaagctgtacgaccattttccgggctctgattccgggtaacggcggtgaaagttttacttgggcagatgataatgccaatctgcaagctgaaattgaccaactagcccaaatgagcactagcgatatggccttacagaaaaaagccctttttattctgactgaaactgggctctcgtttggtaaatactggacaatacttcaaacacaggctctcgtcaatacttaccaaatgttggctaatattctccgcggtagtgccctttttagtgcttatattggttacaaatttcgcctcagatttgaagaactcactgtaagtgatcaaaccgaactgcagtattggattaatacacagtttgatcaactcatgcaaactgaaaaagacttcttagaagctaaccttgacgatgccaccgaagccatcaatctggcctcctatggtgccaatcatgcattaatgtcacttggctttaacgctgtctacgaagttcaaccgtcttcactagtggcgcaactcaaagaactgatgattgaccaaaatcaatttttgcaacaggtaacggctgcaaacaatgaatcggacactgaaaaaatgaccgatgacgactacgacttttaaggagtattcaactaatgagctataaaacaattaattgggacattatcgaagacgaacttgacgaatatgtatgggataaagcaacggcacaatactggctggatacgcgagtacctgtttctaatgatttacgggactggcggacactctctggcaccgaaaaatcggttatcaatcgggttgtgggtggattagccttgctggacacactccaatctgaagaaggagtcgacgtgatgcggcccgacgttcggacacgaaaagaagcagcagtcctcaatgactttttgatgatggagtcaattcatgccaaaagctacggcactattttgacatctttgaacgatcaagccactgttgacgaagtgttcaaatggatgaacaataatcccagaatgcaatacaaagccaaacggatcaatgatatttatcaaacgggaaacaaccttgaaaagaaagttgcaagcgtctttcttgaaggaattttgtactacaccaacttttttaccccactttggtaccgtggtaacaataagctggcaaatctttctgaagttatcaaactggtgatccgcgatgaatctgttcatggtacctacctcggctacaaatttcaattgggatataacgagctatcggcgactgaacaaaaaacattcaaaaagtggatggatgagttgctcgacgatctccttgagaacgagtttgcgttcaccgaagaagtttacgcgccgattgggttagcggaagacgttaaacaattcgttcactacaacgccaacaaggcgctccaaaatatgggctttgaatcccgcttccctaatgctgagattaaagatatcaacccaatcgtaatgaacggaatttcaaccgaaacggccaatcatgatttcttttcacaagttggtgctggctatctaatgggtaatgctgaagctatgagtagcggcgactatgacttctaacataggcttctaggcataattaaaattaaaaaaaggctaatatctacaggaaatattaaagtaaagccccctgagttgtactagtccctgtcaagttgtcatttgaaataatataagttttgctttgcttaaacggcctcattccagtattccgctggggtgaggtcgtttcttgctggtgaacgatctagttgattaaaatagttgatgccttcttcgaccaaggccactaattcgtaaaatgaatttggtaggtgtcattgccgttcatcgactggatcactaagccttccagtaatggacccgcatagacaaagccttcatgctgatggccggttgagataaaggtccattgaacaacttgattaccgctcaaggctgagccgaaaactctggcaccagtcaacgtcccaaccgaattatcagaaagaacaacttgttggtttcctagatttccattgacattaatagttaacattaaaattctcctagttatttcctttatacaacataataatatagcataattgcaatgcaaatgcgaattggttatagtaagcttatacttaaattaaaatatggagatgatgattatgaaaattaatatccatcgttccgcaacaaacaaggtgcttgccggcgtcattggtggcttggctgagcactttcaatgggatcccactttggcacgggtcgtatttgtcattctggcatttaccccattcttcccgggaatcatcgcatacctactgctttggattttgatgaaagcaccagaataattagtgctgtttcagtgatctgcggccaagccagtagatgactgccaacccaccaaaaaataggacaaagaacagtagaaagcattccaagaaaaacgtatccggcagcatgttaatcaccggatcggtgttcgggtcaaaaatccagtcctggtttctaaataatacttcatgaaatgccacaaatacctggtcaaaattaacaaacatcaacgcgataatcactaacgaaactgtggtgacgaccttaattggcgtcatcaacagccaagttagtgattttttgttgagccgatgcagtaggtaggcaccagtcggcactaaaatcagcccaacaaaattgttgaacaggatcaaccctttaacgtcccgaaagtgctgcagtccctttgcagaactgaagaagtaatccagctttaaagaaggaatccacggcaactgtaaataggcgataatcctgacataatcatgatgcatctggctagcagtgcgaccggtagccgcagctaatttgagcggattaatattgaggtcaaacagccaaacactgttgacagtcaaaaagatggcgagggcaaggcaccccaatatgattaaagtgccatagccaatttgttttccaagcattttcacatttataaccgccaatcatcaagtgagtcaatctggtgagtcggctgaaccgattctttggcaacctgttgctttgtcgaaagtccggtataaaccaagagcgtatcgactccggcattaatcccagctttaatatccgtgttgtaattatccccgaccatcacgacgtcagactgttcaaggccaatttttttaatggcactttcaataattctggctttgggcttgccaatcatgatcggttcaacttgggtggcatactcgacaaacttcacaaccgaaccggctccaggcatcattccacgctctttgggaatgtttgtatcggggttggtaccaatgaacgtcgaaccgcttcgaatggctaagacggcctctgaaagcttttcataggttaggtctgaatccagccccacgaccacgtaatccggatgatcggcttccaaacgataatcgttggctaagataacttgtttcaagcccatttcaccaacgatgtaaacagatgaagcatccccactacgatgctcattcatgtaatcaaccgtcgccatccctgatgtatagacattttccggtttgacgtgaatatcatggttatcagccaggttcttaaccacgtctctggggagctgagtggaattattcgtcacaaataaaaatggaatattggccttctgcaggcgctcaataaatcgtttggcggccggaatgcgttttttaccggcatacacagtcccatcaagatcaataaaatagcccttatagtttgtcatcaagtcaatccttctaattattttttactctcacgaataataaagtggtgcttttttgatttttcttcagtcttcacgaccatattatggcgcttttcaactggcttatgggcggtaaccttcttttcttcaaaggcgtggttccgatgattgcgatgattactccggttgcgggaattatgagaccggtttgatcgatggttacctcgattattccgggattttctgatcaccggtcgggcctcaagattatgaacgacaaaataagcggcaccgaagttgacgtcctccaaaatccagtcgttgggtgcagaaataaacgggccggaagtttcagttcggtcatcattaaagaatccccgcaaacgtaatttgccgtatccccagtcaccaacaatgtaatcatactgactaaaagccggattgtaccgacgaacgaattcgtcaaagtcaaaaccatccgtgtgattggtatccaattcatacttatgatcattgattaagaattctgtttcactgactcggttgattcgtgccaatggctttcgattctcgtcttgtttcgcaacgagttcatctaaggtttttctgtccaaagtaaccctcctttcactgattaagtggataatgtttggcgagataatccccaaacacatcccttaaattttcatcgtataaaatttcgttgtggccgataatctccaatgtcgggaagaacggaataaacaaatagtggtccggcatggcaatctggtatgttttcgccggtgaaaccaactcttcatggaaaaagagctggccggcatcttgatcataccgcaatccgccataatgtagctggccaaaatatttgccacgaaagcccatccctttttgtgggaatttggtcaaaaagttcttgttcttttccatttctttgatgaggcgccagagattataaccgtccaaagtgacccgcatgacatgcatcgcgtggggcaacatctgatgcaattgatttcgatcaacaatcccttgaggcaggtcggttaaaaataggcccgaacttaaaatggcagcgcgagtatcggctttttccattatcgcatgcaaaccttcgtttaccaagcgcgaatggccgatgagattagttgtcatgggggctttgattctggcaagtttgttgcgtgccagcagtttttcaccgtgttcttgatattcctgaatttcagcatcatcttcaggttcgctgggcaaatcagcggttttaatcactttggcttgactggctacaatccgatgggaaccatcgatagtcagtgtaatctcaccaatataatggccccatttttcggcagctgccagtagtgaatgattcactttttcaccgtgaacaagtaagtgatgcgtatgcgagccgatgatcacatccagctgaggaaactgacgtgccaatagacggtcggttggcagccccaaatgtgatagtaacacacagatatcatatttgccggcattgtcggcgagaattttaggcaggaccgtttccggtttgagaggctcccaccccaagatcggatatgtcagtaaataaggcgctgtcagcccaatcagaagcacgcgtgtatgctgcggggtggtaataattttgctgggatgagcccatttgggaattgatttggtctgctgatccaaaaggtttcccaaaatgacgtcgaaattggcatcattgtacaactcgtccaattgctcatgactattggtcaagccctcgttattgccaattgtgacggcatcataatgaatttggttgagcaactccacattggccttgccgttggttacctcagtgagcgggtgaacgcgatcaaccgcatcccccaagtcgacagtgataacggaagaatcggctcgctgaagttctgcgcgtcgcgtggtgataaattgacgaatacgtggccaattttcgaaatgggagtgcagatcgtttgtgtgtaaaattgttagcttctcagtcatcaaaccatccaatcttttctaaattagtgccgcttggcaaagtcttcagcttttccggcgaccatttcttcaatttcagcttgggaaaatggcgttccaaacggtggcttctttttcaaataatcagtttccggcgtatccacaccgacattgatattttctttaatcggaactgtataatgatgaatgtgtccatgtaaattaataatttgtttaacgatgcccatcatcatcggatagtgagtcatataatactgacgatgattcatcttgatgagaacaccaacatcgtgaaactcaaacttttgatgattgcccacgggatgattatgctgctgcagatatttgaacaaagcacgggaatcgtgatttcccttgatcaaaaccaagcggccattcaattgatccagcacttcaaaaattttttccagtgccactttctcaggtcgggtatgcaaaatcgcaatgtcaccaagatgatacaccacatcgttcttgcccacccgacgattccaattgttaatgatggtttcattcatatcctcgacagtcagaaatggtcgtggtgcgaactcgctaacgccaagtaaacgttcatgaaagaaatgtgtatcagcagtaaaaaattgcatgaacaggtcctctttcgtacataagttataccattaatgataccacccagcagccgtttagtaatgaaaaagtattcaaacaaagctgataataccaatgaaaaaagccaaggcgccgatgccttggccaatcatcattttttacagaagtggctttggtcgttgctacgcgtgttcgtttgttaatctgctagtatcgtcattttattcaacaaactagtttgtaactggctgagtgtggttgtcatgtagaccgggtaaagatctgggttgacgagccgctgggttgttcgtgggagctcggcaagtttagcctgggtcgttgcctgaatggttgtaaccggaattgacgtggtgttggacaaatctaccggcgcgagtaagggccgggcttcaaaatgggtgagtcgctggtgacggtcgacactgagtgggtcactggtgacgacggttaggctggtcgcatcaacgatcgtctcggtagctagtgcaatcaaatcagcaaaggcccgctgagttcctggttcgtacagacgatagacttgcttatcaccaggaatcgttagtttttcgcgactggcactgaccttgatcttgggggtgctctgaccattgctctcagttgccgcaagcttgtagacgccacttagaaccggtgcggacgcgctagtgatgagcttttcaccgataccaaaattatcgatcggtgcgccttcgtgcaacagcgaggtaatgatgtgttcatccaatgcgttagaaatagtgatttttgcattgggaaagccagccgcgtccaattgtgtccgggcagcttgtgataaagtcgtgacgtcccccgaatcgattcgaataccgacgggttcatgcccagctactcgtagctccttaaagaccgtcaccgcgttaggaatcccagagttaagcacatcataagtatcgactagtagcgcactattgtcaggatattgttcggtccacttgcgaaacgccgttagttcatctgggaaagcttcaatccgactgtgggccatggtactagcaacgggaatatcaaacagcttcgcagcgagaacgtttgaagtactattggcgccaccaataatggctgcccgggtgccgtaaagtgcgctgtccgggccttgcgcacggcgcgcaccgaattccataattggacgtcctgccgcggcataactcagtcgacgagctttagtggcaatcagtgattggtgattgacgatatttaagacgagcgtttcaagtaattgcgcttgctcaagtggtccagtgattgtcaatagtggttcacgaggaaagaccagggttccttctggagactggcaaagtaggcggcggctttttttaacatatcacgctccaatgctaattcggcattttcacgttttaaggcacggttctcagcttctaaagaagcaaacggcgtttgctttccatcttcggtatatagcttccgccaacgatacagggcactttcaggaacaccaagttcggaggcaatgattttaactggtttggaagagttaaaactcaaacgtaccgcatttttcttaaaatcttggtcgtagcgattgcgtgaataggtcattttgaggactcctttcggataaatcaattctcttatgtttctgtccgaaattctagtacagaccctccataatttgtatgctcttttctagtacatatttacgataattattcgattaccaaaaatgccaccattttttattagttatatttttagctgcctgtttttttgcaccatcagtttttgcaacttggcttttttctatactttcaagatcttcaactgggccatctaattttcgtaggcgttctttcaaatggcgatcttctgctactgttgctaattgtaattgttgttgttggtctattagttttgttaaatgatctatttgtctgtctttgctacttatttgctggtctttggtcgcaagctgtttgtcacgttgagactttaaatctgctacctcttttcttagagtagcaattagctcattattttttttgctagtctttgtcgcttttttgctacctatttgttgatcttttgctaccaaaggctttgctaccttgtccctaataatcctttcagctgtaaggctaatcatgtttgtaccttgactatctttttgttggttctttgttggtagtctttggtagtgatattgaatagtttgtttagagaccttcaattcatcagcaagttctctaatagttttaggcatgttttccaaacccctttcggagttcagaaagcatttcttgtcttgtctgatctcttattgttttatcatgctcaatctgtcgttcggctaaaatctgtttttcagttgagcctagtggtaggcctttaactttatcggtagcacgccatttttcttgttctgttaattcaccattattctggatattaaaaagtttttgacgctcatcttggaacttaccttgagaaaagtcgtttgcgtcttttctttcaggcttccaagtaaaagtataaccaatcactggtttcccacgacctttaccatatttttttcgtatagttaggcctctaaacaaaggggttagttcttccttaattgggcgaataaccctagattcaacgttcgcaggcttactccaatagctttgtggaatatctagtagttcaaagaaatcatttttagaaaaataagcataaccagtggttcggaattgtttaagaatacgaaaagttgtttttgcgtaactactctttaaatctcggaactctgtcaaagcataacgaacccaactttcgagattatttagaagtttcaacgctttgggataaatttgaatatcaacataaggaacgtctgcagatcccttaatttcaaatcgagtgaacatgacaaacatctctctatcaagaccatctttacttcgagagccaaatctaagacctagtattttttgatatgtactttgtatgtcatcaataaaccgattatttgcggttggcttataggcacttaactcttttaactgatcaaaggtaaatctaacagtatcatcacctttatcacgcattctagaaactacagaaaagaacaagttcatttctacaggagtaaaccttcgcaaggggattgtatttaattcagggtcatatttgactaattcattgctcataaaataacctccttgaataatactaccttatttgaatacaggagtaaataaatgtagtcgataaacagacaaaatgtagtcgataaacagacaaaatgtagtcgataaacagacaaaatgtagtcgataaacagacaaaatgtagtcgataaacagacaaaatgtagtcgataaacttctgtacgccttgggggagtaaggcgcaagaggggtctaaaagaggtttaaaagaggtttataaaagaggtatataagaggcaccactgtacgagatacaaacctaaaacaaaaaaaacacaaaggagtgagccaaaaaacggctcacattaaactccagtcgctatgctccttgtgcctcacgctgttcgttgcttaaaaggtgcggcaagccacattaattcgggcgctgacgccccgaaccccgtccaagctgagccagcttgactgctttttcactcgccgttaggcaggaaagcaaagttttgtagaaactttggctttcgccatttcagtgtaaagactggttaagagctgtcaattccttatgctcccacgctgcgcttgtccgctaccattgacagcaaacagttagtttttttgaatcttaacaagaacttagctgctatgttcgttttttagggccttatttttcgtttctagcaattttaagactattcatatacatttataccaaagcaaaacaaaaagccctcagcaggctcttagagggctaaataacgaagccaggatgattaataatatcttcttgtcttttttgcaaaatataagtgtataaggaatcatacaaattctttttaatctcgtcaggttcattgacagaagcttcaaacaattcttgaatatcaacttgccaaggatcagcaagcatttcatcaattggttttaatactttcttttcgtcaatcttaatgactcctaacatcaaaataatgctttcagtttaaattcacagatcttacagcaccgttattcaaaatttgttaccaagcttataaaaattctctgcacaaagcaattaaaaaattttggcttaaaacagcgtaatctgcaacactttttaaatatttaaaacataacaatcttagttaggtgcaaacataaattgaattaaaaatacagtcaattcaacaacagcagaaattgattttatggttatcagcaggtcgagtgaaacgaggtcaatgcgcacttataccccactaaaatttagtgggagttttgtgcttaaaatctgtatcagaagttgccttcggcaacaactaaaaactcaaagaaaactaaccaaaatcaatttgatctaacatactttcggtacttgcttggtctaagcctaaataagctaaagtcatggcttcacttgaatgatttaataagtgcatgactaggccaatattgtaattggattgcgtataaacgcgataagccccggttttacgcatcgtatgggtccctagataattaattcctaacagatcgccaaccttgctcatgattttatagaactgtttttccgtaatatgccgttctgggtgttgaatggaaggaaagagccattcagaatccagctgatgatcaagcagccattgacggtacaataagagctctgtttgaacaggtttaaggtacaaggtattcggtttaccagtttttcggtcaaaacggtttaaggctctctttttgagttccaatgcagttcattctgcttttgcggccagcgtcatctcgtctgctgtgcctgccacttatgaccaagctgttgtttcctctgacaagtcgttatggttagctgctattaaggttgaacttgatgctcatgctgagaacagtacctggtctttggttcatttgcctgctggtcgtcgtgctattggttgtcgctgggtatttactatcaaagattcaacaaatcctccaacatataaggcacgcttggttgctcaaggttttcgccaggtttatggtcttgactattttgagacgttttctccagttgttcggtacgagagcattaggattgtgttggcgctttctgcacattttggcttacttattcatcagatggatgtttcaactgcatttttgaatggcacattggatgaagagatttacatgaggattccagatggtattgatgcgcctcatggcctggtttgtaagctaaacaagagtctttatggtttgaagcaagctcccctttgttggaataaggcaatcaatatggttcttttatctgctggtttttgtaggtccaccaatgagtttggcatttacaccaaggttacagataagtcaattgtggtagttgctctttatgttgatgatttgctcatttgctctaacaacatggttgatatacaaagtgttaaagatcttttgtcttcccattacaaaatgaaagatctcggtgttgcttccaggtttcttggtatgaatcttactcagactaaatttcatgttgagttgaatctttcccactacttgaatgaatatctaagggacttcaatatgcaagattgcaatcctgtttcaactccctttgccgctggtactgattttttgcctggtgattccatttcggatgctgatgtttcgcgtttccgcagcatggtagggaagttattatttgctgctaatacatgtcgcccagatttgtcgtttgctgcgtcaaccttgtcacggtttattaaggatccaaaggccaatcatgttgctgctgctaagcatgttttaagatacatcaaaggtacaatgaattatgggttatcatataatagatgttcaaattttaggttggtaggttacagtgattctgattgggcaggtgataagtttgataggaagtctattactggctatgttttcatgttgtctggctgtgcaattacttggaagtctaagaaacaatctacagtagctttatcatctactgaagctgaatatatggctcttggtgacactgttaaggagctactatggttggtgcagctagtacaaaatattggtttgaagtttaagaatcccccaactgtttttgaggataatgaaggctgcaaattactatccaatcatcccgttcaccatcaaagaaccaaacatattgatattcgtcatcatttcattagagagcatttgaacaataatttattcatcttggagtctgctagtactgatgacatggctgctgatatgttcaccaaaaatctcaataggttgaaattcaagaagtttgttcatttgatcggtatgcaagatgtacttgtttagattatggtagggtgttgagatggtaatctaaacaagcatgcctttccccacctcatgtggtctaccccactctgtggtcatgctaaatcaagtgcatgcatgacgttctccaccttatgtggtctaccccactttatgtgcttacacgtcccatgaccacactcaattaaggacatggcctatcatttagggccatccccactttgtttttatgccaagacagaaatataaaaggaggtctaattccccttgttattttagtttgttctgtctcttgtattgtctattcttttactttttgtttatttctttttataacaatacaattatcaatatcatctactatggattttaatcaaaggatattgacccttcaacaggttatgagctccttctctcacctatgccccaagaactctgtcattactttgaaatcggcagagaactatcacaactgggacacaggtgttaggtcgatcttaaacacttttggttcaggtctcctggagttctttactgacggtgacctattggtccctccaggaactgccctcgatgatcccagtgttgttcagttaaccctttacttgaatagggctctccaggttgtactgacaactactgttgatgctgaggtcttatcgtcctatcagtgtgaaggtttgtcaggctctgctttgttggcggcaatccggagagattattcttctttgtcggctcggcaactctacaaaatggttgatacattggttaaagcatcttcaatgcagactactcaaagtttgttatttttgaagactatcagagctcagtttgctcatggtatgaccatcgatcatttgttagggttgatttatcttaagagttttaacgacactactgttgagtcaagagttcttgacgtttcaaatccccaattgggtttatcggctattgaagttgcattgaaggacattaccacttcatcttattctacttcgccttcctctcaagtcctattgactaagaaaactattaacaaccggaggaacaaaccaaaggaacttgtttgtcaccggtgccaagctaaaggtcacacctcggtcaattgcacggcgcctgctcctgttcctagatctggtgatctttcttcctcccgttcctctgctcatgacaagacccaagatgatatctcttggtctgttaacactcgtgtctccattgatgacacgtacacccttgatactggttcctctctccatgtgtccaacaatcttgatcattttgttgactacactccgtctatcactacggagaacgtcaccggtattgccgatagtaagcttgacatcttaggctatggcactgttgctttcgttcttgctgacaagcggagattattgatcagaaatgtggcgtacattcctgacgctgtgagaaatttaatctcgatccatcttgttacaagaaatactggtattaagtttgtctttgaagattactcatgctatctaggtgatggtacaatggttggacgctttatgtctggcacactttaccaatttgttccaaagcctatccggtccgctcatgttagcttatcagttcaaggtaacatcatgcactccagattgggtcatccttcccctgaagtcatgagagccttgggctttactcctcctgatggtatcaagatttgtcctgactgctctgctggtaagatgacgagaactttcccgaagttttctaccaccaagaccacagctcctctccaactcattcattctgatgtgtgtggtccgatttctgttcctggtttaggtggtgagaaatatttcttgacgattgttgatgatttcacaagatggtgttccattgtcgctttgaaggccaagtctggtacaactgaagcaatcattgattttatcaccaatgctgagactcattttgcatctgctaatcataaggtaggtgccttaagatctgataacggcactgaatattgcaacaaccagttgaaagcctatttgcgtgctaaaggtatctctcatcagttgactgttccgtacaattcttctcagaatggtgttgctgaaagaaaacatcggacaatccaggaaaaggctagatctctccttcatgagtcgggtttgcagttgaagttttggacagaggctatcaaggtggctgagtttcttgccaatcggtatccatccaaggttttggatgatgttagtcctttttatttgtggatgggccagaagcccaactactcgttgtttcatgcgtttggttgccagtgtgttgccttgattcctccccagaagcgcaacaacattttttcgcctgtttcggtccctggtatcttcgttggatacagtcctactaacaaggcttaccgtgtctttgttcctcatttggacaacgtctttatctccaacaatgttcagttcgatgacacttctttcccaatgatggatccactcaagagaccacgtcttgttgagtctggtgacctcacaccttcggacattttctttggtgcgagtgctggtggtattcctgctgtttctggtggttctggtggttcatctggtgttggttctgtgtctgcggttgttgatgactttcctgatgatgttgctgatccttcgttctctccttcaccatgtccatcgcgttcaacttcgtcggaaaatttttcgccatcctcggacgaaaatttcaaattcgcgcatagtgaaaatcgaactgaggttgttgagactgcggacgatgcatttttccactcggctaatcatgatgatgaagaagtggcggcgaccacggttcaacctgaaggcgatgttgcctctgacaatttttctgatcctggtgctgatgaggatggtgaggttgctccatctactacttcaactgctttggtctatccggtttatgatgaagttcatcaggttccaattgaaccctctcttcttcctttgcgtcgtgtcagaagtgatgtttccgttgatagtgttatccaaccacctcttcaaaagcaatgtatggtccacatgaagcctatgcctcctcttattccacaacaacgttccattgaacaagtgtctgaagttgatttttctgaggcttagacaaggacaattaatatatcatcaacccgatcttactgatgtaagaaggtatgctcgaaaagaactagataacttatggggcgaatataaacgtcaattgaatccacaagaatatcccgtcgatttatcacaaaagttatataatcaaaagcttaaattaattcagcaaattcatcattcttttatcatctttcagttgtttacaaaataaggcacctttattgtcggtgtatcaacaaatagggaatcctttaaatatcagaaaatattaatatattctagttttattaaaacgatgtgcgatatgggaatgttaaatgtcccttggtaaaacagtaacgtattcttagattttggtatttaattgctgatattagattttatgcgttgaaaagttcactacaaatatagaaattgtgtttacaactagtcatattgtttgaaactgttcttaaccgcttattcaagacatgttttaattttattaaaatttgaaaacatagtgtatgtattttttagtgaggtagttatgaacaaaatagatgaattagttaagcgtgtgaatgatgcagacgctattattgttggtgcaggaagtggaatgtccagagctactgccctggacttctggtatcaagatagtcccttgtatatggataatatgaaatattttgcgaaaaagtatggttttcaaggattatttcaaggattctataaccattttgaatcagaagaagagcattgggcattttatcttgaattatacaagatgatgatagaaattcctccacaaaagccaacttatgaatacttaaaaactttgattggtaataaatcagctcattacgtcactactaaccaagatatgctttttactaagtactttcccgaagatcaggttagtgaaattcaaggctcgtggaattatttccagagttcgcggccaacgaatgatcgtaagctgtatccgacaaagggaatgttagatgttttgtacggtaagattgaaaaccaccgattgccaagcaagttaattcctaaaagtgacgtcgatggtgcaccgcttatgccatgggttcgtggtccggaatttttggaagatcaaaagtactacgaagaacataaaaaatggaaccaatttatggctgctcatcgtggtgaaaagttgctctttcttgaaatgggagttggccgtatgacaccaatgtttattcaagaacccttctgggaaatgacacaatatatgcctaactctttctatatcaatattaatccacgagatgtacaaactaatccggctattcaagattgttctttattgattagagaggatattaataaggctcttaaagaagcaagcataaaagttaaggaggaccaaaatgactaaggaagctgctaagacaacaaaaaaatggattaacgatgctgatgcaattttagtaactgcaagcaatggtttatctatttctgaaggattaaatttatttgctagcgatgcaaaattaagggaagtcttaggggatttggttgataagtaccacttgccgaatcttattgctgcgtttagctttcaatatccaagtcaattagactattggcgtgtaattgctagaacggttgaatactacagtaaaagatatcaacctagcgtctatatgaaagatttgcacggcattattggcgataagccatactttgcttggacctcaaatgctgaccatcatttctccttagctggttttgacaatgtctttgaagttgaaggaaactggctaaaagggatttgcagtgctcatcctaagcaacatggtgtagttgatttagctcagaaaatccatgagttttacactaaagatcaagcagggactttaaccgaggctgatattcctacttgtgaaaaatgcggtgcgccacttaaaattaacactactgctaatccaaactttcaaattgatcaaaagcaagttagtgcgtttgaaaactttatccaaaaataccaagataagaaattagtagtcattgaattgggaattggtccacgcaaccaaatgatcaaggcaccaagtatgcaactagtagctgctactagcaatagtcgttatatcacgattaataaaggagaactaaatattccagacttgattgctgatcgtagtatcgggtattccgcttcaattagtgatgcttttaaggaaattttatctggtcaaagctatggtgcaacaacgcaaggaccgacgaaaaggaaacccaaaccaaaattgacccctgaacaaaaggcagaacaagaaaaagtgatgcagcaattttatccaaattatatggcagacccaggatttagacctggtagctttccaatgtatctgactattgattcaaggcatccatcttatttgcatgcaattcagtatggacaatcaatgatgtattccatcggagatgctgcaattgttcactgctttactcaagacgggaagtattacaaagttacattgggactcaacaaaagaaaaggcgaagttcatggcttctatgtcgatccgggcacttttactgcaatcgaatgtactaataatatgggcgttggtttttcacagattagcactgaaatgcctactaaaggtgatggtgctattctagtaccaaagaaagataagttactgaaaatgttcccagaccaaaaagatattattgaacatttctgtatttaggatggattcgtgatgaaaaacagaaaaacggatagacgtacgctctatacattgaaattaattaaggacgctttcttgaacatagtcaataaagattcattttcacatgtcaatatcgcacgtatttgtcgtgaagctgaaatcacccggtctaccttctatatccattactcttcaacaactgatgtcttaaatgatgtacttaacgatgcattgctgttaactgagaccaattcttcaccattttttatgggaaaggataaatcatttaattatttaaaaagcaacgaatcattagtaccagcatgtcagcgaattggtgataatggtaagtatcgaaaattattgatggatccagatttaagtgaatatataattggcagaataatgataaatgagcgcgagaaagtactaccacttgtaattgaaaaaacacatctttcaagagaagaagcggaaaccttatttagatatgtaattcacggttctttcgcagtgaatcgcgcccacaagtttgtaaaagacgaaaaatggtttcatgatgttcaaatgttaaatgaattcgtggaagcaggatatgaacggttaagccataattaagagaagtattgtaaagttactcctataagcccaaactaccgtatttccaacgtaatttagttattttctaaaaacacacatgccttcattaattgtgtctttagttgttggataaggctgtttttcttgtgctttaggcttatcttagtaatgctattcaatgctatctatttgtttaaaaactgcgccatcatagtgtctagcgttgtgctaaccagttttaactagaaccgtgaaggtaaaattacaaagatgttgaaatactaaatttcttgctaattctgggattatatatgttaacttttactcatactttagccttctctaggataattggacattagcagtttttataattggtaatcatcatcaatttgcttgtcagcttgttgtaattgttggttattggccagtagtatggccttttttagtttgataatagggtcattttcaagttgccgttctttatgataatcgaaggggtgttttgagggtcgaatactgtttgtgtcaagttgggcgctgtgcaggtttgatattggttggtttaattctttagtagatggtgttgtgagagttttggttacttgtttgatgaattcggtggctttatttttaatcttttgtagggatttagtagccgtgtccattagatatttaagggtttgtcggaagtgttgctgccggccagtatcagtttgaacttcttgggcgacctcgtttggttggagaagtggttgctcaaccttgtgggtcgggtcattttcgacaatcgtattaattaattggttcttgtaaccgtcaatttgattctgaactgttttgttagtggcctggagttgttgattttgagcggttaattgttgattggtacttgataattcagcctttttagtacgagcagtagttatctcctggtttagattatcaagttcatcttgatggttttgtttgtctttttcccaatcagcacgctgttcttgacgccagctgtcgagctcttgttccatttcagctacgttattttcgtttactgtaattggttggtcattattatcaagtaagtcgttttggtcgatttcctgttgagcggctttaattcgttgttgtttccgttctttaagttggtcgtcagcgtctttcagctggttttgcagggtttggagttgttgtcgttgctgagctaattgctgttcttgttgcttctgttgctcttcagcggctttttgttgtgcctttgctgcattagctttagctttaggtgaattgatagttgggacaacataatcagttcctactttaaaaccatgtttaactaattgaatgttacgtgggtcataggatacttggaataacggcttagttcccgctgccaagtcagctaaataagtgtcgggcttagtttgagtcaagtcaacatctgttccggcaacgtggcaagtaactactcgtttctgaataatggctaccatgccgcccttttgaaattcgtcacgttgaacaactaggccattagtcggagtagcagttgcataatcaatggctccagggccgaagatgagtgcataagtagttccatcagaagcaaccggaatgctatcatcttgaatgatgctcataccttgataagtggcaattggagtagctgcgccagcaggttgcaggtattcaatcaattgttgttcacgcatttctgaataagctgctgagttaacaactaatgtcgataaggtgttatccattacatcacccatgcgggcaagtgctttaacaaagtctgaggcggataattctttttcagaacccacaccataagtcttggcagtcgcgatatcagtattgttaaaagtggctttaacagtatctaaaagaatctttgtatcttggcgagtccaccagttgccaaagcgattagcaatctgctgttgggtacttgcaccagaaatcaaatctccccagtcagtattaccgaatgacttgctttgatacatcttaatgccgtattccatagcagaatcaacaccattatttgaatatcgttagtatcattccattcatcagcatcaccgcttaaatcattcattgcagggatctcaactgatcatcctggttgaagcaatcggccacctaatactggatcgttttttagcacaccagattgaacaaatcgattagtttgagtattttgacgatagatccagtctagaaagactgttggttcaattaaattactaaaattcgtagggtttccgttaattacggtcattacctacacctcctatttaagtttgttgtacaaatctgggttttgacgataaaggttagtctgctcttcaaggctcatctgcgcaaaatcttcgcgtgtcatagaagcgttaaattgttgaccgccattctgtggtgattgattacccgtaactttcttttcaacagcttcctgaactgctttgttaaataagtttgtaaacttatctaagttattgttacgaacatcttctttaacatcactaataaactccgcaaatttagctggaatgtgcttgtcagttagaacagttttagttgcagctaaagcatccttacgatcagcttcatctaatttttcttgaagacggtcttgctgttcttttaaggcttgtcgttgctcttctaaatcggcttgggccttctcactagcattcatgctggctcgtttttcacccttttcaagccattcttgttccttttgcttaagctcccttttcaaaatcatcccgcagattgctttctacttctttagccttagaggccatcatctttccaataccatcctgtgtgtaggtcttgccagctggctttggatttttaccatcaggatttgggttggaatcgtttggcttaggttctgggttaggatcagcaaaaaattgcaaatttgttttcatcatcaaaacccctttttaagtccgtagactaaattgtttgtaagtgcaataattaaatcaattattctttaacgcctgtaattgagaaaaaggcaaatcaaaaattcctattttaaaaagaatggcacaatcgaataacttgtatgcaaatattcaattgcctataattagatttagaaggatgcaatttagataatggaggatttcatatgaaaagatttagactttggtcaaaaatatcaattatcatttctatatctcaacttttattagccatttttaaagaaattcaaaactataacaaatctaaaaaacatccttcgaaaaataagagaggatgatgttttatgcattggttatgggttttaattattggtgccatcattggtgctattgctggagcaattactagcaaaggaaaatcaatggggtggattgctaatattgttgccggattagttggttcctctattggagaagctatactcggatcttggggccctcaattagccggaatggcaattattccttcaattattggagcagtaattgttgttgctgtagtttctttctttgtcggtaaatcaaagaattagtttttaagcttcatttaaggttcttatactaaattatagatgctaacttagttagcacccctcgactttgttgtgagcgaagccaattaataatattcctgacccacttagttttaaactaagtgggcttttttgttccttaaataccctatcaagttcaccagacagcagattcccatcttcatcacaggctaccagctggcaacgacaccttggatgagtatccgtgactggaatcggtgcttgtccataggcaaatgtttgtctatcaagtggttcacaaatatcacaaacacgatcatcttcctcggttaaccacatcacatactgaacattctgttcatcatacgctctattcttaccaccgttgctattgcgtatagcttcattagttgttaacgtatgaattctggatagcatttggttcataggcgttgctaaattgtcatcaattcgatcaccgctttgaggaatactgcgggtcattttattgatgtctgattttttcatgcggcgactcaaacccttgttcagggtttctttcattcgtgtcgtcatgacgtcgccatgcacccaaattcgttgagaatactcagcttggttggctactttatctggaactgttgatagtttattagggcttgaattattatagccatcgatatactgctgtttgagttcattaactgcaaatgattcactttttgctgtagcaatattcataccggcgccaatcattgcacccaacatatcacgccgagaaatagatgcttgggcaaagattgcttgcaagcgtttagacaatttatcactaggactagcgttagctagcatttcatcaattgcttggtaaaaggtagatgatgcagtatatgttgctatattcactagtgacaaaactagagttgaccaaatccttcaattgattggcaacgacaatgttgaatgtactgattatcttgaagataacttttttgcttggatgttttggaaatatgatcgaaacaacaggcaaattaattctgatattggattgccagcaatgaatgcgttctcgggaacaattcaacgagatgatttgcaagatatgataattggtcgctcacctaatattactgatttatcagtcttaaagatgcatatcgcccgacagtttccattgagaagtgtcggaatggagttaactgagcgtggtaacaaggtatattttaaagttgatgttcataatcaaattgttgttgatacgagaaaatctaaaatggttagcgatgggataactgataccgttttggtggaattaaaagaatatccactaatagtgtatatctatagttacattattccactgctcaatggcctgtatgaaagtgaagagccagatttcacagaacaattaaattcctatagtaaagacttagcaaaggagattattcttgatttaattggagcaacgggtattgatatacaagaatttgataaattagctatgaagctttagttgtactaattgcaaatgggactacggaaacttttaatagatttatcgaaaagttcagctaatcactgttttttttgcatatggtcaggaggtggcgatatcatgattaattcatagtaaatacgggtatgagtttccggagtgggcacaggcgggtgctcggctcgataagatggtgtaaggataatagacgtcgtgctaaatagcgtggcgtttttattttgcccaaaatttggaggtggccggcatgggccagatggtaaatagcagatttggccttgtcagtcgcacagagacacgttgcttgggtgacttagaacatcagcttaaaagatggacggtggtaacgtaaaaagccgcagcgaccacataagccgcgtattacagtgtggagaaaaaacagggtaacaagcgtgaaaaaataaaagaagaccagattttggtcttcttaaaaatgataatttatttatcgtctttatctaacttttcctttacgttatcaaccgtatctttaacagcatctttggcatctgacagtttatctttagccttacctagaataccttgacccttaccttcagcttcgcgggccttgtcgttcgtaaccttgccttcaacttctttagcttttccagttaccttatctttggtgctatcaattttgtcatctagactcataatataacctcccataatgtatttgttacaacagtattattccacattttaatttgcttgtctaataaggagatcctacaagagatagtgtgaatgacacttataactaaaaacgacagccattaacggctgtcgtttttagttggttgaactttatttgaaatagtacctgcttaactccaatgcgctgttttccatcaactgctgaccgtattcgttgagaacctcttcagtaacagcggtcttcttgccatattcattggcaattgcaacttcatcactgacgaccatgtcaacggggtcattgctgaatagttcaagcttcaagtagtattttccttcatacaagtacaaatccgatgtgccattttcaagtcgcaatgccttggcgagcgacacaaaatcatctaattggtcgaactcaagaattacagtccgcttttgatgaccaaattcatcgttagtctttttatcacttacaggttgcggtttgttattatcggcatgttctgcgatatatttggaaacccgatcacgtttttcagggtgatctgaatcagagtcacctgcatcgaacatgtcgttatcagacatatctacatccttactgataaacaattccaagccattttggtttggaagaacttggaaagtgacggcatcgttattttgaaattgatggtctttatcaacttcttcgagaatactgtagaagaagctttcgatctgcttgtggttgcccagcaagtcaagcacggtaatgccgcgcttgtcgagatcatcattaccaatcaacacacgaatcgtattctcattaatccgttccatttccatatttagccacccctttcaatatctgagggtaattaataataacattgtatcctattattgtctaagtaaataatacggctaaacatgaatattaacaagcaattaagattccaagactataaggcttttttgaccatcttttccaattcgcattttcgagtgctccgtggcatgaagcaacgaatttcatcttcattgaacccaaactcaatccgtttggcatccactaaaattggtcggcgaatcagttctggatgggttgccagcaaggaaatcacctggctgatggtcattgaagacatctttgatttgtattggtcgtacaaaaaagaccgggtcgaaatcacatcatcggtgccgccttcagacagcatcaagatttgtttgagttcaacttcagaaagtggcttggcaaaaatatttcgttccacaaaatcaacctcgtgatcgatgagccattgttttgcttttctgcaggaagtgcagctgggggttgttaataaattgactgtcataatgtgaatcctcctagtaatcatttgatgctttgattatatcggaaaatgttatataaatcataagattcacagaatagacaaacaaagaccttattttgggcaaatttggcttagatatccacagaaagatgagttttggcaaccaaaattggcatggtctcccccgccgtcgtttgcgcctccgtctttaattgctccatgtcgccatttgcaggtaagtgggtcagcagcaatcggtgaacattcccgtcatgagcgagttgcccggactcagtcgatgtcatatgccatttctggccggtttttgtcgcaaagaagttcgtatcagtcatcaaaagatcggcatcgtgaacgaattgggtcaattcagggaaataagctgtatcggcagtgaacaccagtaccttaccggttgatgattcttgaatacgcattgcaaatgccggaacaggatgatgggttttgaaaaatgtaatcgtgaacgggccaacagtcagtgtttgacttggatcataggcgatccctttagtagatttgggccagctaagtcccttgaagttgatctcatcgagggtgtgcccgtaaatcggcaatacgggctcgctgtaccttttttcatgcaattgccaataatattgcaagacgcccacgtcagctgtgtggtcgtgatggtaatggctcaaaatgacggcattcagtttcagagggtcgacaacctgttccaagctcaacagtgcgccgctcccacaatcaatcagtaatttaaaatcacccgattccaaaagataactgctggtggcatcaccatgatccggatagccgccaagaaaaccaatcactgttagtttcaaaagaattcctcctctttcatctttatccaatttatattttacgctaatttggggtaaatgtttggttccaatattgaaagaaagtataataaaattgtatataggaggtgggtcaaatgaacgaacagatcgtcattacatttggaaatgaaaaaattttaacagaactcaaggcagcgcatcctgatcgggatttgatgatgtaccaagctctcagccaaccaggtgaatttatgctgctggaccattcaggtaaagattcagtcttcaaggcaccggttttctatgatattttaagtcacagtggtgaagataagtgggacggcttcattagcttctccacattagatttaaattttgatcaacagaaggtttttgatgcgcgcatcaacaagctgcgaacaaatggccttcccgatggcatgcattcaatttattcccttaattatcacaaggacatcagccaacgaatcattttgggaacttgggatgattacgccgacttcgaactttggaagaacagttctgatgaattcattccaaaagagtaccgtgattcaccaaacttctactcacatgaagcttattacacaccagctaagaccaaaaagacgcaataaaaggttcattcaaataaaaccgttaattgatgaagtgcaaatgacttcactgattaacggtttttgtgttggatcagaattttatgtaaaaaaaacaagctacctaagtaacttgaaaactttcgatgttccaccggttcgtacgagactcgaactcgtgatctcctgcgtgacaggcaggcgtcctaaccaaatagaccaacgaaccaaaattgcgggagctgggtttgaaccaacgaccttcgggttatgagcccgacgagctaccagactgctccatcccgcgataatataataagattctcttgaatgacccgtacgggatttgaacccatgttaccgccgtgaaagggcggtgtcttaaccacttgaccaacgggtcatttaaaacggagaaggagagattcgaactctcgcgccgcttacgcgacctacacccttagcaggggcgcctcttcagccacttgagtacttctccaaaatatgggcctaaatggactcgaaccatcgacctcacgcttatcaggcgtgcgctctaaccagctgagctataggcccattatatgaaaaagcgggtgacgagaatcggactcgcgacaacagcttggaaggctgtggttttaccactaaactacacccgcaaaaacaatattaaaaacaagtggcgcgggacagaatcgaactgccgacacatgcagcttcaatgcattgctctaccgactgagctaccgagccaaaaccggttcgtacgagactcgaactcgtgatctcctgcgtgacaggcaggcgtcctaaccaactagaccaacgaaccaaaattgcgggagctgggtttgaaccaacgaccttcgggttatgagcccgacgagctaccagactgctccatcccgcgataataaggaggatgagagattcgaactctcgcgtggtttgacccacctagcggttttcaagaccgtccccttcagccacttgggtaatcctccataaaagctgtataaaaactccagtatataattgagtcgatggaccttgtaggactcgaacctacgaccgaacggttatgagccgtttgctctaaccaactgagctaaaggtccaagacctatatcgcggcaggggggatcgaaccctcgacctcccgggtatgaaccggacgctctagccagctgagctacaccgcgatgaaaaatgatagttatgctatcaatcgggaagacaggattcgaacctgcgaccccctggtcccaaaccaggtgctctaccaagctgagctacttcccgttaaaacaatgcacccagtaggagtcgaacctacaaccttctgattcgtagtcagacactctatccaattgcgctatgggtgcataatatgccgaggaccgggatcgaaccggtacggtcatcactgaccgcaggattttaagtcctgtgcgtctgccaattccgccaccccggcataacaagcggaagacgggattcgaacccgcgacccccaccatggcaaggtgatgttctaccactgaactacttccgcaaaatgccgactagaagattcgaacttccgaccccctgtttacaagacaggtgctctgccagctgagctaagtcggcatacaaatattatgcgcttaataatattcaattgtaatgagccgtggcagtctcgaactgccgaccctctgattaaaagtcagatgctctaccaactgagctaacggctcaaggaatggaggatacagggatcgaacctgtgacctcctgcttgtaaggcagatgctctcccagctgagctaatcctccataaaatccgaccgaaaaactggtaaacctaataccttgtaccttaaacctgttcaaacagagctcttattgtaccgtcaatggctacttgatcatagactagcctctgaatggctctttccttccattcaacaccccgagcgccatatcacggaaaaacagttctacaaaattatgagtaaggttggcgatctgttaggaattaattatctagggacccatacaatgcgcaaaaccggggcttatcgcgtctatacgcaatcaaattataatattggcttagtcatgaatctgctcaatcattccagtgaggcgatgacgttagcttatttaggcttagaccaggctagtcaagaaaacatgctggggcaaaccaattttgggtaatatcaaggaaaacattacctcaatcattttttataatacattgataaataaaataaaaaattaggagactaattatgcgactttggcatgagcaactcattagcaaacttcctcgccaacaactgttaggacagcatcgggaaattgctgctttaagaggcaatggctggggaaaaaagcatgcaactgttaattatgtattcaattactcaccgtataaactttatcaatttcacttgctggtcatgcacgaaatgcagcggcgcggatatcgtcctaataaaaaatggtttgatccgctttaccgtggtatccattgcgatccatatataattttgaaaaagtgtccgataactaacccgatttatccagaacataatgattcgtatttgaaagaatgtttatctaatttagccagtaaggggattattttataaatctaagagggtatctcattcgaaataccctcttagatttagctagtaatccgcattgaattaagatactggctagcttaattcaacttttaaattgcttacgatctgttaataaagcaatcggtgaaagaattaaaataatcaccgctcctaccaaataagtataactaaaggcatgactgatttgtcgctttttagcatgcttaatttttcccatagaattcattaaagcttctttttgtgccatttgcttgagaccaaccagcaatttgtgtgggccttgatttatttgttgattactcgcataatcttatttccattaaatagcatgcaacaatatatcatatcatgatatattgttgcatgctatttcataatatgctattatttacttgcaaataaggaggcacactatgaaaataattactttttcagccattaagggcggagttggaaaaacaactttaactttcaattatggtgaatggttatctagtaagggttacaatgttttgatgattgatagtgatcaccagtgtagtttgacccaaacttatgatatttataaagatcatgataccttagctaatgtttttacaaaagataatgaaaaagtagaaattattgagttacacaagaatctatcaattatccctgcttctatgaatctagatacaattaacaatgatcttcaaactagagcaaacaaagaattattaatgtacatgtggttttcagataactataatgaactaaaaaaattcaattatgtattgatagatacgcatcctgatttttcaactatcacacaaaatatgattgtaatttctgatttcgttttcagcccaattgaaccaagtgaatacggttttatttcaaaaagtaatttggaattaagaatgaaacaattgaaacaagatgtaattaatgtcgaaactcgacaaagttttgtcacagcggaacttaaattcattggaaaccggataaaacataatactaagtcatctcatgagtttgtagaacaaatgaaaaaagacccgcggacaattgcactaattcctgaaagagaaatattcaataaaacaactcttaatcacaaaccgctgattaagatggagcaagaaaacaattcaacacaaagggccaaagaatttttcgaaaatatcgacaatatctttgaaacctttgcgaagcaatagcgtaatatgatatgtcatgctatattatattatgagacagaaaggactagtataatggcatttgaagataaaatgaatcaactaaaaaatagtatgagcagcaaacctgctaaaaatgaaccaactgcacctagaatttcaaaatcttatactttgaagcaagatattgctaatgaactaactagacgtgcaaaagagaaagaattaacagcttccagatatttagagaaactgctaaaaaaagaatttaatctttgattttcgctaattgaaaaaggggtaaaatcatggaaactacaatgaacgagatattccttgttgcttgtattattattttttggctatttcccgttatcggcattttgaagagacataaaataggcaatcgtttcttttttagacaatggttattcccgttacaataatggttacaagtactatttgaaaaatggagtggtaatcgtcgatcagttatccgtatattacaaatgatatccttgtttattacttatttatgcggaccgatcatgcttttgattttcagtgctttcaacgaatactttcttaaacacccagaggcatttatattattcgaatatttactgatatcttccggctcttattggttcaaacccaaagtaggcaaagtgtacaagaccaaataaagttgccggcgggtaagcgctatgctagactaagattaatatgacaaccgaataaaagatcaagctaaacagaaaaaagtccccaattcacgaggaatcagggacttcaggtttagcaagtagctatctgacagctacttagattcagtcgatttagaccgccaagtaaaaatcaactgaatattgttcttaatttgtaggttaattataccgcaaaccggtccaaaaggacaagttaaggatagttaaaaaacaaattaaatccaatggactaagtagccaacagaagctgcctagtccatttttgtttagttgctataaattaaaaaagttgccggttgggcaactcacaaacagacacatgctgatgaaattgcaaagccatcactaccaaatgtacgctttgtaacttagttaaagcatatcagatttgtattttaaagcaaatcaaatgttttggcaactctcttttgggacagcaggtgtcagtcaagaagggagtttttatgatggatcaagcaaattttgatttttataaaaaagataacgtttatggaactttattttttcaatttcccaaggtactaatgtacggagaaaaatataaacacctaagtagtgatactaaactggcttacatggttctcaaagatcggctagaatattcattacgaaataactgggttgacgaaaatgacaatgtttattttgtcttcacaaacgaagaattaaaaaaactatttgactgctcaaatacaaaaatcgcaaaaataaaaaaagagcttgaaggtgctcatttattaatgcagaaaagaatgggttttcaaccaaaagccggccgccaattacccaaccgattgtatttagcggaattaaaagttaatgaaaaagatgtttatttaagagaaaagaatctaaatagctcccaatcccttgatacgagcagacttccgaaaaacggaaatcagcatgagaccgttgaatcccttgatacaagcagacttccgaaaaacggaaatcagcatgagaccgttggtaacatatcccaatcccttgatacaagcagacttccgaaaaacggacacaatctatataaagaacctagaagcttagatactaatagatacaatatagatactcaaaagttggacttttccacagcccatttttcaccagcagaaattcaaaagcaaaaccaggatttggtgcaccatgctaatgacttcttaactgatgaagacaacggcttaccggttttcttagaacccgaagccgtgcaattactaagtttctggtgccgcactccgcaacaaatgcgccggtttattggtatcattctgaatgctaagtaccgagttgaaaaggatcatcaagatattggggttctaatcccgcttgacgacgaagaactaaaacctttgatgactaaagccttgagacgctactttaacgccctgagaagcaatgaaaagcacatcaagaacgtggaaaactacttgtacggcaccatgcaaaacctatttggcgtttggtggaataaacaagcggctagagaatatgcagccaaacaccccgaagaacagaacactgacaatgagccttattggaattaaacgccgtataagctcatttaagccgttttaagtattacatgcataattatattaaaatcgctttaaaatcgcttagaagcaaaaatagacaccttgagtggctgaattggcgcttggtggaataaacaagcggctagagaatatgcggccaaacaccctaacgatgagcgtgcttaaaactaaaaagctatataaggccatttattgagaaatttatgtgagatgaatcccccttgaatgattatggggggaaatacatatattggtatatattaattaatattattttgtgattttgataatattatgcatatattagattttggttattgaactatcatttttgaggacaaaatagctaataacggtcaaataacggtcaattaaaattataaatgcctttatatcaacgtttataaggggcacttgtgcctgcagtcggcatagcatttcgcaaaaatagggaaaccaacgaatgacaatttgttgggttccctatttttgtattcctgcttgtaatatctccatgaaacaccatcataaagtctgcggacgatgtcagacgagaattggtatacaagaaatatcacagattggtatatgataataatattttgaaatagcctgacgtaacggtacccgattggataatcaggaaaaatcgggcttgtggtatacattgttttgcgttatgctgtactggtaaatacaaattgtttgggagtgaacaaaatgaaaaaagtattattaatttgcgagagtggaatttccagcaactttctcgctaaatcggctaggccctttattgaactgtatgatgcaaagattgaactgattccaactaacattaacaatgcggacacatatttgggtgatccaattgacttagtgctcgttgctcctcaagccagttatcacaaaaaagaacttgaattgtttgaccgcgcaacgcaaattaaaacaattcctgacgagatttatggttgggcaaacggggagaagctcgttaagttcatcatggcccaattatctccgattggggcagcttaaaatgactgatgagcagttaaacgggatcgccatgaaaatgctgacttattctggcaaagcaaagagcatcttatcggacttgatggatcatctcaactcatcaagtcatgatagtgatattgatgcccaattaaacgaagctcatcagtggttggtccaggcacatcagcaacaaaatttggtgattgccgaagctgagacagttggatactcattgctcttcacgcatgcccaagacacactcatgaatacggaaacaattgaatttgtgattagaaagtctatcgctgcatttacaaatcattcataagttcaatccggcatccggttattaatttgatactacttacgaaataggtcttgcctaattttgctgtgtatataacttgtcgtgacctccgattctgttgaattaaaattcaatctggcctataatggtctgtatgatttattcttgtaatgaacttcaggagtaatttaaaatcaaaaatctaatctgattaacttgttttgttaataagattagatttattttttggagggtatcacatgcaacaacaagatcaaacagaccaggaacgtcgcgcagatgcctctttctttggccagcctcggggactctcaaccctgttcttcacggaaatgtgggaacggttcagttactacggaatgcgtgctattcttctttactacatgtattatagtgtaactaaaggcggccttgggtttgataagccattagctgcgtctgttatgtcgatttatggctcgttagtctacttaacctcggttatcggtggctttgtgagtgaccgaatcctgggtagtcgccggaccgtgttctatggcggtgttctgattatgtttgggcacatcgcgctgtcgttgccaatgggtgcgccggcattattcacctcaattgtcctgatcacgattgggactggactattaaagccaaacatttctgaaatggttggtgggttatataccgagtatgatacacggcgcgattccggattcacaattttcgtattcggaattaatttgggatcattcattgcgccgctgctggttagttggctcggattcaacgtcaacttccaccttggcttctcactggctgctattgggatgttctttggattactgcaatatattcgcggtggtaaaaaacatttgcctagtgccagcttgtatccaagcgatccattagaacccaacgatgccaagaaattgactatccgggttggtttgggagtggttgtcttcggcttgatcctgttgctcatgcaggtcatgggggcattatcactcagctcatttattaccttgctgagtatcattgccgtggccacaccaattatttactttgtcgtcattatttccagcaaaaaaatctcttccaccgaacgctcaagagttgttgcctatattccactgtttatcgcagctgcgattttctgggcaattgaagagcagggatccgttgttttggcactatttgccggaacccaaacgaataataatgttggcggtatttttaatatttcgccaggttggtatcaatcgttgaacccactgtttattatgctgtacacgccattctttgcttggatgtggattaaacttggcaaaaagcagccgagctcaccatccaaattttcactgggattaggtattgccggattatcctatctgtttatggtgattccagttgccttatttggcgcacaagcaaaagtgagtccactatggctgctcggaagctgggccattgtggaaattgctgaactgttaatttcaccaattggactctctgttacgaccaagctggcaccaaaagcctttgaatctcagatgatgagtatgtggttcttagccgattcagctggtcaagcggtcaactcacaaattgttaaatactatacaccggacaatgaaattaattacttcttgatcgttggtctggttgcaattgtcgccggagttttgttggcattcctggttaaaccaattaagcggttaatggaaggtgtcaattagattcaagaacgaccgaatgtgttatcctaatttggatagcacatttttattttggggagaaaacgtgatggtaaagattgccgtaaccagtgataatcaccttgatttgaacaaggtagcactggccgatacaattaaacagcaggcgacttttttgcaggaccaaggggtagacgattacctgattgccggcgatctattcaatgattttcagaagtcggtggattacgttcagcagctgtcagcagccgttgctccaatccgagtttttttcattgccggcaaccacgacatgatcaaaggtgtcagttatgacgagttggaaaatggccagtggccggggtatctgaacaaccaattctttgacgtccctcaaaccgactaccgaattattggcatgaacggctggtatgactacacttttgccgtgaatgaagataaaactgaagatgaatttcatcgttggaaaatggcctactggatagacgggctgatttcgcagcctatgagcgatcctgaacgtgagcagatagtcctttcggaattgacccaacagctccagaacgcgcaatcagcgggcaagaaagtgattttgatgactcactttgttcccaaccaacacttcattcattatacgaatgattttcgcttctggaatatggccaatgccatgatgggcagtctgcattttcaaaaattgattgaggactatcaggttgaacgggtcgttttcgggcatattcatcaacgactggtgcctattaggcttaaggcgacgacatactataatgcagcggtgggataccacaaccatcgtcacaatgagtggcagacgaatgatttcatagctgaatgggcaaaacagttgaaaatgttccaaattttttgatgattgcgcttgacggaatcactaaaattttgtattattatattcgttggtttgatagcaacactcttttggaggggtagcgaagtctggctaaacgcggcggactgtaaatccgctccttcgggttcggtggttcgaatccactcccctccatttatttttgggctatagccaagtggtaaggcaacgggttttgatcccgtgatgcgctggttcgaacccagctagcccaataattgattgttacccgttttcataggttgtcaaaagcctgtgaggacggttttttctttgctctcgattgtcatgaggtgtcactaattgtcagtgaaatggtattcaatatggtattcaattttgagtgataggagtagatccttcaaaattacctaaattggtctactctaaaagtttagatattttgcgagcttctcagttgcctcgttcgattctttgcgcgtagtggccgtgtagatgtccatagtagttttataggacgaatgccctaactgttcctgaactgctttcacagacgccccagactcgaatgagagggtagcataggtatgcctgaatgcatggacggtgactttcttcaagtcgtaattaccaatcacatgctttagccacacttgcggcttaactggctggaacatttcgtttttttcattagcaaaaatgaggttatctccgataggaaattgttgaattgagactatcctagtattgatatccattgaaatagatgcttgttctgtattaaaagaaactaaataaaataagtatataggaaattctacaataagggaaggaaaggggagtccatagaaggtggggggacacccgtttatataataaatctgagaaaggaaattgaacaccattcggtgtagtggaagccgtaattccggttcggtggagtggaagccgtaattccggttcggtgtacggaaacccgacaccaaccacacttgaaagtttggtttaaccgtcatacgtcaacaacctgaccatcctgttgattaacttgcatacccaagaaggttttaaccaaaccaagatccttcatcttgtagtgatacgagagaagatccttcacagcttggatttgagatgcatcattagaacaaataagcaagtcatcaacatataatgccacaatcaccacaccatttggacccaccttggtatacacgccatattcgctgattgatcgagtgaagccagcagagactaacacagcattgatcgcttcattccagcagagaggagcttgttttaatccatacaaggatttgtcaagcttacaaacatcgtcatcagcgccagtgacaccatcaggaagtttcatataaatttcctcattgaggtgaccattcaagaacgcagtggtaacatccatctgatgaatagccaggccatattgagcactgagagcgaaaataatccgaatgctgtcgtaacgaaccacaggactgaaagtttcaaaataatccaaaccttgaatttggcgaaaaccttgtgccacaagacgtgccttgtacgtgggaggggagttagcatctttaatgttgaagacccaccggcacccaatggcccggcgacccggaggaagcttgacaatcgaccatgtatggttcgagtcatgagcttgcagttcagttgcaatagccgcagaccacaaggaggcatcatgggaagcaagtgcctgtttgaacgtcgctgggagggacgaggaagaaaccgcagcagcagagaaagcttgatgaacaatattgtgagagacaaattcagcatcagattgagatgagacaggagaggacacagctggagaaggcggagatgaatcagcaggattcagacgaggtctttgagcagcaggatagagagccaaagtcatggagtcatcagttcggatccgacggagaggaagaagagatggaagcatcggaggagtagagccagcatcaacttcctcgtagacaggatacacatcatcactggcactgaccattgcatcaaggatgtcagaagtggatggagtgacatgagcacttggagttgcagatgcactaggagttgtagaaacacgaggagtgccaggagcactcgaagtgacaggagaaacaggatcagaagtactcacaggagcaacgacagcaggaatactatcaggagcagcgggatcaggaggactagcgggagacgccggagcaaggataatggatgcagacttatcagaagtcggagaggcagtcacatcaagggcaggctcaatcacatccagctcgccagcaacagcagcagcatcagtagtaccttcaagagtgtcaacaccggcaacaaccccgacaccttcgtcagattcaacatcagagacagcagcaacttcgtcaacgtcaacgtcaacatcggcaacaggctcaggcacacgtggtggagaggccattgacgcttgaacaccttcatcagagtcagtctcagcataggacaggttgctatcagaagagtagtcagccgcagtatcgtagtcagagtcggaagcatcagtagcttcaggggatacaacgtccgaggcagggtcaccactactagcagcagtgccggtttgaatagccataaagtgcgatagaggtggcataccaccagccatcttagtaccaaagaaaacatccgagggaggaatgttttcatgaacaccggtttgaaagcctgcatttaaaggattcaacattggaaaataggagtcatggaatgtgacctgctgagagacaacaatatcttgcaattcgggaataaagattctgtaccctttgcgatgaggatcatacccgaccatgataccataagtggagactgggtcaaagatgtctggtcggtgggcatggggaatcaggacccgtgaatggcacccgaaagaatggaggactgtgtaatcaggaagatacccatgccataattcaaaaggagtgaccccagacaagactttggaagggtaacggttgattaaaaagtcagcaactttgactgcctctgaccagaatttcttagataagcccgattcacttaaaagagtacgagccttttcttggatagtccgatgtttccgttccgcaacaccattttgagatgaattgtatgggactgtcagctgatggtgaatccccttggtgtaaaagtattcacgaaggcgattattgcaaaattcaccaccgttgtcagaacgaaccgcagcaaccttgaattgaggaccaaatttggtttcggattcgatgatgaagtgttcaagagcctcagccgcatcagatttggacactaggggaacaatatgagtccaacgagtaagatcatccacaatagtgaaaaaatagcgctcaccggcaaggccgggagcggagataggaccacagatatccacatgaagcagttgcaaaggacgtgtagtcttagttgttgcaagcttgggaagagtccgggtcatgttgccagcaaggcagtgatcacagaacttgacctcaggaggaggcttgtgacccaatgctttcatgactgcaggggacggatggccgagacgcgaatgcatattcgcagagaaagcatgatggtcagaaatggacttgtttgggataacaaccgagtagataaactcgtaaagatttggtgagttgtaaattccaataggggtaccatcagtcaagatacagtcatcaggaccaaacgacgcacgaagaccagtgatgcctgtgatgactttgaccgagatgagattcttggtcgcatcgggcacatatgccacattattgacagtaatgtattcgttagaatcattctggaacatgatagagccgaaacctcgaatcggtaagatgacaccaccaatacctgtaaagaatccactgccagggccaagagatgtgaaatgagcctggtccttacacacatgtgcagtcgaaccagagtctaatgtgtatttctcggatagagaaacataggaatcagaggtctcagacggcccaccaatacaagcccatgaaatgtgcttgggtggggcggatgattgctgagacgtggaaccaccagttttaggaactggcgcaggcgcagggcactcgatggaggtgtggcctttgccgtggcatcgtctgcagaccacttggcccgatcgaggctgagatggggcagacgagtgcttccgtgaaggttggctgaccgcagcaaatgctttctgatgctcgtttggaacggccaaatctcttaaggaaagttcaaccgagtgcagactaagctgtgggtttgccacatccaggatcctggattgtgctgaagggtcagagaaagagcttaggtagactagaccgaaaagatgatcaatgtcaagaccgtgggcaaattgagttctaaaggttctaagaaccttgagggcttgaggaggttgcattgatggaaccttcaagaatgtgctaactagtttagatagttgacgagcagagagagacgaatagtctactctgatggcttgtaaaaggtcatagccggataggccgtcacactgaaagttgcccataatatctgcatcaaccgtattgagcagaacaatttgaagagcacgattcaggtgaccttttaaaatcatgacagtggcatcgtcgatgcttccatccaaaggaatcaggaggttgccttcatcaaaatattcatataaccctaacccaagaggaactagaagagtttggacaccgctcacccaagtgtgatagttctccgctgatttcaacatgaaagtggagttcttaggacacatgtgggcgattccactcataacctgttgaagtccaactagtctagtaggtaaatccatgatatatgataaaatctgtattaaaagaaggtctacaaaagctataggaaatcctatatagtaatagtaaaagaagtgtgtagacattgaggaatcttctaagtgaagaaattttcactgaagagatattgatcatatgattgatcttaaagaattaattcatgaaatgatttaatcaatcatttcaagttgatacgcgaacaaaataagcggcggtttgtttattaactagataactatattctggaattttaacttcattttcgtaattcgtcatcaaacgatgatttattaacgtttctgacactgcaaagcgttggaccttaccaatcaatagttccttgatctgagctaaattttgattagttgttcgaactttataaattgcgtaattttcatcatttaaaaggtacacttcattccgtttatcaactgaaaaaacgattcgcgaaaatttaccactaaacctggtcttctgatcaaacgcgtcatttaaaataccgctcgtcacattgtccgggtactttaacataaccgtattatcacgggcaactaagttttcatacgccttacgactattgatcgattttcttgttacaccccgtaaatgccatttttcaatagcacttcggatagagtccgttaggctaacgttggtattgttaattaaataagaattcgtgtccgattgatgataaatcacctgcgttggtaaataaatatcaccaaccgatttattcgattgttcactttgaactacattactatttcgacttgattgttgtttcgttttttcatagtgggccggatttgtccaaataaaccacgacaaaaccacacttaaaaggaccactagaataaggccaagatgaattaatattcgactagttcgcattcctctcattcccactgatcctcctcgtctaagggctcgtaaggaagggaaatatagaatatggagcccttgccttccttactatcaacccagattcggccgccatgcattgaaataatttcctttgagattgccaatcccagtccagttccaccttgtgcgcgtgaacgagctttatccacccggtagaaccgatcaaagacatgggtcagatccttcttcggaattcccagtccttgatctgaaacgcttaaaataacgtgattatgcgtctctaacaagcgacaagtaattgtgccaccatcaggtgagtatttgatcgcattattcattaaattatctaacacttgttggaacttatcagtatcaacttcaacccaaagatcacgacgcgtaaactcacgtttgatgatgtaatttttatcaggattatcgtctgtttttaggatcatgtcaaatcgatccagaacatggttaaacaactcatttaagttaataagttccaaatcaagtttagctgttccagaatccattcgtgacaagcttagtaagtcattaatcatccgaatcatccgatccgtttcttcttgagtcacttttaaaaactgtggtgcaactttaggatccttccacgcaccatctgttagagcttcaatgtaactctttaaactggtcaatggtgtccgtagttcatgagagacgttagaaacgaattgtttacgatcttggtcaattttttgttgttcagtaacatcatgtaacacacaaaccagaccactaataaaaccggattctcgctgaattaatgcaaaagaagcatgcaaaattagatcttgcgttttagttgaaaaatccagcacaatatcgtcttgattttctaacagttctcgcaaagtatacgtggttcgaatatctaaaacgtccagaattgattttccagctgtgtgttccgcatcggcactcaaaaaatcaagcgccatgtcatttacaattgtgatccggccacgccgatccgtggcaataacgccatcggtcatgtgagcaagcacactatccaaccgtcgttgttcagactcagtggactcttgtgcttcctcaacacgcacagacaggttatttaccgctgaggctaattgccccaactcatcctttccatacacatgaacgtgtccagaatagtctccacgggcaattcgcatagtttgtttcttcatttcttcaattggtcgcgtaatggctcgcgaaataataatggccagcaacaatcccacaacaatggcaaacgaagccgccacaaagaaaattagtgtgattttattaacgtttgaataaacactctctaaattcgcacgcacatataaagcaccaaccacagtattcgtgttaccgctggtgctaattaacggaataattgaaatgtaatatcgattattatttccctgatcataattaacctgttgataggaacgcgaattataaatcacatttttaatcgcttgatctgttgttttttgaccgacaattgattgttcgttcagatcacttgacgcgcgtacggttcccttgttatcaataacacgaatttctgtaatgttagtattattcacatcagaaacaatctgttgaatctgtttatttgctgaagtgacattactttttccaagttgctctgaaatttcattatcaacataggttcctaattgaatttgactcttaaactggcttaaattttgttgctccaattgacgtacaaaaataaccccgacaatttccaatgttatcattaataacaaggcgaataccaaggctattttaaagtttatcgattgatagaaacgggttttcttgttcataaccaaacatggctcccattatttttcattttctggattccgtaaataatatcccactccacgtcgggtaactaggtaaatcggattacttgggttttcttcaattttttcacgcaaacgccgaaccgtaacgtccaccgtccgcacatcaccaaagtaatcgtaaccccaaactgtctgtaagagatgttcacgagtcataacctgtcccatgtgctgagcaagataataaaggagctcaaattcacgatgagtcaagtcgagctggtcaccacgccgcgaaaccgcataggcatcgggattaatatccaaatcaccaactttgatgtcattgctttcttgttcagaactaactaactggtcttggcgacgcaagttagccttcacccgggcaactagttcacggttagaaaatggtttcgttacataatcatcagcgccaagttccaagccaactactttatctaattcagaatctttcgctgtcaccatgataatgggaatactatgttttgcacgcacacgacgtgcaacttccaaaccatcaattttgggtagcatcaagtccaaaagaatcaaatctggttgttcatcttctactttttcaagggcttcttccccatcataggctttaataacttcatagccttctttagttaaattaaattttacgatgtctgaaattggtttttcatcgtcaacaattaaaatcttttgcataaaacttgtttcctccttaacagagtcgtttttgattgaaatctatatgatcttattttcgccaaaaagcttaaaaacattgcattcttattataccacacgacttttagcggttacattggtgggacataattactgatatataccatgtgtaatatcagtccatagtaacttactccacagacaatacaacaaatatcgtataactcaattggttttatacttttctataataaaaatgagtaaaaatgataaaatgattagaaaagtattgcatttttattttttgagatatattatgaccaacgaggagatgatattatgaaatttagtttaggaagtttaggcaatttaaagaagaccgaatcctttagtaatttatccgatagttttgctggaattcttaaagaaaatggctttatttaccataaactgggcaaagtaagactatcgtagcttggtgcaaaaaaaatgatgataagccaaggttgatgacatatgcattggtatagtaatacaacattaatgcgatcattaacatacatagataaaatgacgagtacatggttaattaagaactcgccattttttgtagaaaaattagtcacatctcattcaaataaggaaaattttcaaaattatctaggtatgagaacttatctttattaaataattttgaacgataccagataacccatgattttttctatttaactaattttggcattaaacaaccagcaaacacgcaaaaaaaatattaatccaaaacgtatcatattttgaacacacaatcgaagatggactatttatttcatttagggaagataatgttgatctttttgctgaatttttttgattggctactacacaaatactccaaaatgaattctaatagtctctctaatgaaattataggattaataattaagcgtttgaatatattttttaggccagaaaatcacaaattaaacaggctcagttacacgaaagaaagcttttataattcttatcacacatttaattgactggtataagaaattatatcggtttttttgtattcaaaactgaaatagatggggaatgcaaaaatgaatttaaaggcatttgtccaataagctgacacgatttcattgatgcgtaagaagacaatatcctgcaggccatttcatcaaatgagcacagcttatcaaaacccgggaaaagtgagtaagtaatagtgggttcaaaatatcttatcctttatagcggcatagtaacgctgaaaaaatttttaaaaaagttatctgaaaaggaatacaaatttagcccaaaacggcaattattgaagttttaacatgcttgtttttggaaccagatgtctttcagaaaagtagaaatgaaataatgactgataataggtatttttgttctgtaattaactgtgaaaaagatcaaaaaaaacagcctagataggctgaaaaatttgtaactgtaactcacagaataagaaacacactaaagattaaatataaaattacgtttacgattaaatgcagttttgattgcttaataaattgggtagctagccatgaaataataagtgtaccaacggcaattaatccgaaggttgttaagtgagtgactaataaaattacgatacaaagaataccaagacttaaatgaatcaaaggaccataactgagtttattaataaaaaatggatagaaaataaatagaaaacctaataaaggcacgactagaactgataagaagttggttgataaaaagccacactggatgtaaaacaagacttccggtaatataaacgccgagcttatggtatacaagattagccctgcccagttgtttttaaaacctgtgaaaaaagttgataaagttaccatacataagaagagcaaaatacttatcgttggcgaaatacttgagaaagccaacgcagctgcaaggactgtgactccagtcatactcaaaaatataggtgttgaaattttattggtgaagcgatcaaagacaagaaaattaaacatgaagataaataatatgactaaaagctgattgctaaaagtatgctgaatattagtatgtacttgatggctgtacagggttggcaccaaccaagtggtcaaactctgaatggccgtcatgattagcggcaacagcgattttttattaacagcattcaaacgtatattttgcatcgttgtattctcctatgtgaaataactcaatcgtaaacaaagttcgaagcgacgtcaactaaaaatcaatcttttaaagaattttcatttgtgataagattgttaggatagctttcaatttccatgatcgtggagacaagcagattagatgcaatcgtattgcgaatctaggttcatgtgaaattcataagctgcaaagcacgggttataacattgaacaaacatactttgttcccgaaaggatttgctgtaaagcaaagatgccttgtaaccgttattaataagggggaaatttccacatgcaagagagacatttatttacttctgagtcagtttcagaaggacatccagataagattgcagaccaaattagcgatgcaattttagatgctatgttagcacaagatccacaggctcgagtagcttgtgaaacaaccgtgacaacgggattagttgttgtcgttggagagattagtacgactgcttacgttgatattcaaaagaccgttcgtgaaaccatcaaagaaattggttataaagatggtgaatatggatttgatggtgacaattgtgcagttatggttgccattgatgaacaatcaccagatattgctcaaggtgttgatgattctttggaaactcgtgaaggtgacgcggatccattagacaaaattggtgccggagatcaaggtttgatgttcggtttcgccattgatgaaactcctgagcttatgccattaccaatcatgttaagtcatcatttgatgcaaaaaactgcagctgttcgtaagtctggtgaaattcaatacttgcgtccagatgcaaaagccgaagtgacagttgagtatgatgacgatgaaaagccagttcgtgtagatacggttgttttaagtacccaacatgatcctaatgtaactttagagaccatccgcaaagatgtgcttgaacatattattaaaccagtgattccagctaagttgttggatgataagacaaaatactttattaatccaaccgggcgctttgttattggtggtcctcaaggggatgccggtttaaccgggcgtaagatcatcgttgacacatatggtgggttcgcccgtcatggtggcggtgctttttctggaaaagatgcaactaaagttgaccgttcagctagttatgctgctcggtacgttgccaagaatattgtggctgctggtttggctcataaagttgaagttcagttggcctatgcaattggcgtggctgaaccagtttccgtttcagtagatacctttgggactggtaatgtttctgaagaaaaattagttgaggcaattcgtaagatatttgatcttcgaccagcaggaatcatcaaaatgttagatttacagcggccaatttataaaaagacagctgcttatggtcattttggtcggacagatatcgacttaccttgggaacatacagataaagttgatgacttaaaagagttattgaagtaattattgaaatctcttctgcaattcgcgtagaagaggttttttaggtggagagtgaattaatgacagcgaaaaagacaaacgttaccttagtcacaattgcgatttttgtggcaacatttttaacagcggtagaaggaaccattgtttcaaccgcaatgccgaccatcgttggagatcttcatggcgttaatttaatgaactggattgtttcaatttatttgttaacaaatgcagttgctacgccaatatatggtaagctagccgatctttttgggcgtaaacgaatcttcattattggcatcatgatttttattattggctcaacattgagtgggacggctaactctatgccaacattgattggttggcgggcgctgcaaggtgttggggcggggtgtattatgccagttgcaaacaccattattgcggatatctacccatttgaaaaacgagcccgtgtcatgggctttaatggagctgcatgggggattgctgcgattgtggcaccgttgctaggtggatttatcgtggaccaactcacttggcactgggtattctttattaatattccgatcggtttgttaaccgttgcaatgattgcactttacctgcatgaggatcctcacacagtctcaacgaagatcgattacttgggaactttgtggttaacgatggcgttacttagtttgatgtatgggtttcaagttttgggtgaaaccaattttacttggcaaactgttgaaacttgttttgcagttaccgttgttgcaatttttctgtttattagaagagaacaaaaggccgatgatcctattatttcgttaaaactattcaagaatcgcacgtttattacccaaaatttagcgaccatgttggtttctggatttttaattggttttgaagtttatattcctacttggacacagggactgcttggtttgcctgcttccttggccggttttgcagtcacgcctagttcagttatgtggatttttgggtcatttttagcgggtaagtttattcttaagctgacacccaaacaaaccttgatgattagtctagctattctgtttgtcggaagtttgtggttagcgttattgtcacaaacgacaccattttggttgttctttgttatttctaccattcttggtgtgggatttggaatcacgattacttccacaacggtgacttcccaacgattagtcgaggcaaaggatatgggtgtggcgacttctttcaatacattagcgcgtacgcttggtcaaacgatcatgatgtccattttcgggatcatcatgaatggtactatgaataaaggcattgcccaacattccaatttgaatttagggatgatgaataagctgattaatccgcaaacagcttcctcattaccagctaaattattgccaacgttgagaactattttatatcaggcgttgcataacatttatttggcaggagtgtgtttgattattttggccattgtgataaatgcgattgattatcgaaaaaaacaaagaatttaagaaagtcgacttttagtatctattagtatctctttctttaggttctctatatagattaagtccattttttgaacttccgctcgtagcaagggtttgagagctgttgtcaacgaacttatgcggaagttcattttttgaacttccgctcgtagcaagggtttcaacggtctcccgcggaagttcattttttgaacttccgctcgtagcaagggtttgagagcttttttgaccaaattcgccgcgtaaatagacatcggttgctttcacatcgagcttggacagatataagcgattcggttcatttttcttagttttcgggttaaagcccatttgtttctgaacgagtaatccgattgattccagctctgcttttattttgatgacttttccctttgaacaattgaacaagtccattagttcttgattggtaaagataaagtagacgtgtccttcactatcaacccagttattgcgcaaagaatactctaatcggtcttttagtaccatataggctaatttagcgtcattgcttaaatgcttgtattgctcgccatacattaataccttagggaactggaaaaataaggctccatatacgttatctgcttcatagtaattaaaatttgttgattttgtcataataaaaactccctttcttgactgacacacgctgtctcaaaagagagttgctaaaacattcgacttgcattacaatacaaatctgatatgctctaactgaattacaaagcctcacggctaaatgaatgctttgtaatttaccagcatgtgtctgtttgtgagttgcccaggcggcaacttttttaagttctaacaacaaaaaatggactaaatagctctggttagctacttagtccattgactttaatttgtttttaactatccttaacttgtccttggggactggtttgcggtataattaacctacaaattaagaacaatgttcagtcgattttaacttggcggtgaaaatcgactgaatctaagtagctgccttatagctacttgctaaacccaaaatccctgattcctcgtgaatcggggatttttctgtttagcttgatctctttattcggttgttaaattaattttagtctagcatagcgcttaccaagcggcaactttatttggtcttgtatactttgccagcttttggttgaaaccagtaagcgatagaagataccagtaaatattcgaaaagtaaaaatgcttcggggtgtttaagcaaatttccatcaaaaacactgaaaatcatgagcataagcaacccgcaaaaatacgtgataaacagggacattatttgaaaaattcttacgacaatacgacggttaccactgattctttcaaataacagctgtaaccaatactgcattggaaataaccactgtcgaataaaaaagcggtcatctaccaggtgcttttttgcaattccaatggctgggattatccaaaagacaataaggctggcaagcaaaaatgtaacatttatcgaaattcccataacaactccccccttaaagtgacatcacatattttttataagctcatttaaaaatttggaggcagacttaaaattatgttctttggctagaccgtcaagtcttttgcgtgcgctaggttgaagtgaaaaggtatagttcttagtacgttcctcttcatctttaaaaacaggaataacaagtttatctttagtatcagttggctgttctgtttcatttttttgtagtgccttttttatgtttttgttctctggatcgaatgccataggtagtcctcctttataattcacatgcacacacattgagtatacatgtgattaatacgtgtacgaaacatttatagcttttccgtgatttcattaaatgttttgtccatactatcaaaaaattcatgttgatcaatatatgttttgtggtcttcagccatttttgaaagagattttttatccaacgttgaacgattgaatagctccttttctggaactgtagccaatacactgggatcgccttttaaggcttttaataactcgcgagatgatcttgtgttgtgtttaatcatgttggcgataaaaaataatttggtcgtgacataagattttctagtagagtaatcaatggcttctttgcgtaattcgttaattctttcttctaggttaaattttgcattatacccatgttcgctaggtgtgattggactaaggatagcattactaatgattactgcattcttggtagcagtagaaaaatctgggtgacaatccaaaataatatactcgaattttcctaaatttaaacgttcataattatctgacaaccacatatagaggaacatatttttgttagtcttattttcaatggtacgctcaatatcgtcaaggtgcatgtctccggcaattagactaatataagcacttatttcatgtattttgactttccctcgatctaagaaaatgttgccaacggtgtcttgattgtcgtaaatgttgtaagtctgggttaaattactttggtggtctaagtcaataaataaaacatgcttgccattttttgctaaccattcaccataattaaaagctagggtagttttaccaacgccgccctttatagctgaaaatgtaataatttccattagtgtccctcctcatacatgctaagtaagcttaataaatatcgctacatgcataataacacataacacgtatgtttgcgaatgatgcatatacattatattcatgaattattagtatacactagctaagtgccctatctcttgatattaagttttttacgatatcgaataaaagttgtccgcttttatgtaagcgcaaggaaactcgttcttttaaggacgtgctgaattgcgctatttttacgccgtaggtactttacacatagcataattaaaaatatgctataactgcttgcttggcctaatcaggtacttgtaagcgctgaactgtgttatactagcggcgtagctattgatcgttgttcaggtaatacaaggaggttttgctgatgaccacacactatgcagcacaaattgtaccattgaatgcggataagattggaacggctgcttatggcgaagcgacgttcgcaattgcagatgatgaattaacgattaagatcacaatgcacaacacgccggccaatatgcagcattgggaacattttcatggctttccggatggtaagcaggcgttgatcgcaacggctgcacaggatgcgaatgcagatggttttgttgatctcatggagactgaagccgtttcggggacgacgatggtaccttttgacgatgccccagaacatatggatattccccatgaccgctatccaactgcggatgagcacggtgattttacttatgagaagaaagtcccattaagtgagctacaagctaactttaaaaaagcatttggtgagtcggaattacaccttgaaaaacgcgtgatctatattcacggcgtgactgctaacgtgcacttaccagaaagtgttgccggaatggtcggccactatgatgcacacgttacgttaccgatcgcgactggtcagatcgttgcggttgattaataagcctaaaaaataaggaagttggcccgattggtcaacttccttattttttatcagctattgatcggcaacttttttcaataatcgtttcatctccgtgatctcttcacgttgcgttttagcgatcttctgtgcgagggctttgacttccggatcgctgagttgcgcgcgttcactggttagaatcgcggtcgagtgatgggggatcatttcttgcatccaagctgcatcgtgcacggtcgcttggctacgaactagataaagcgagccagcaaatatcaccgcactaccaagtaggatcaggcggttcaaacgtttattctggtacattgaccacatgaataacagcattacaatggccatggtggcgcccataattagcgccatatacagtcgcgtttggcttagaaaaatatgatctaattggaacacattaaggtacattaacccatacataataactgtagagacaagaatcatcagtaaaaatttcgtgtattgtttcatgacgtcctcctcgctttcgctggctttattttgactgtaacaaaaaaaatagatgttcgacacatatttttcctgtataattaaaacttgtagagaagttaaggcggtggctatttccgatcggaggtggtgcttatggtgttaaacctttaaagcccattaatcctaacgaaaggagtagcctaagtgtccgtttcggacgctttacaattaatgctggctttcggtacctttaccgtggccttaatcgcattaattgttgagctgatcaaaagtcagcaaaaaaaataaccgccttagctctggtcagctagcggttattaaatatcgttaaaatctgccaccgtcttaaacggctctacacgggaagtcctgttatcagcggggcttcctttttcttactcacattatagcatgactatgaaaaattgggtagcaaggcattttcagcttagcatttacctttgtattttttcaaaataggtgcaactaactctttttcggcttattttcgagcttgaattgcactttccttatccttaaaatatcctagattgtaacgaacgtgttttactgtgatataactacgccacctcttatcacgtttactataagaaacccctgttacaccactcgcattatttgcttttaatttatcgcctattgctaatttcaatatggataatttagttcctttttctcgaccgtcattttgtctaaaggtatgttttaccttctcttgtattttttcatctttgtaaatagatttccatttttctcgtgccttctttaatcgacaaccacaactttgggttgttccttgaatcagcttagtgcttgctacatcggtataattgccacaatcacatttacaaaaccatgtagcccccgcgccttttttaacaccattcgattgtcttaagactgtcagcatgccaaaccgtttaccagtcagatctttgaaattaagtttcgcaaatttagccctattctctttatctaagcaaccacaacttttggtaatacctgctagtaaattactagtattcacttttgtcttattaccacaatcacatttacaaattcaaaatgcagcatgcccccttttcgggacttttctcttcaactaccaatctaccaaatcgctttccgattaaattcggagtagggcggcccttttgtcccattcaaatcacttccaaatttatttagttgcttttctttccaaaaacccgactaataaatgtttttgagcaaattactaagacaaacaaaaagcataacggggcaataactagtacgcttaaagctaaaacttgaccaacgttctaaatataatcaagtattagggcggtcaattgaacagcgccccatcgtagttaatcaacgtaagcgcatcggtgattttgaactagatacgattgttggcccccgtgggcatggtaaagcagttttattaactctaattgatcgcaaatcacgttttctttgggcttaccgattaaaagatcggtcagaggcgactgttaatgaagctctaactaagtttctagcaacttttaagggaccggtacacagctttactgtcgatcgtggcaccgagtttagcggtctactatcatttgaagcacaatacggtattaagacctgttactgccatgcttatacgccaactgagcgtggcagtaatgaacgctttaatcggaaattacgttacttttatcctaaggggacttgttttgagcacattagtgctcaaagcttgaaaaccaccttgctcgaaattaatcaaagaccacttaaaatacttaactggcaaacaccttatcaggtcatgctaaccaatttgtcaaaaaattcggattaaatttgcaatctaccaataagatattttttttatacaatccttgcaataaatgacggagttttcttttaaaaactttcgtatctctgtaaatgaacgtggtggtatgctgatcttgaaaaaagcttcatcccaggtttttaattctttaccacaaatactacatttaatggtcattagtattacgcccctttcttagaatggcaaaagcaataatgaatgcaattagtgaacctgacaataataatatggcaaaaataccggttccagctgtattaagatttaacaatatgcaaactagtccaactaagtcaaccgaaataatacctacggtagctgtgaacaaaccatgtttattggtatagtctttcgcaataagcatgcttctaacacctgaaaggaacagggtaaaaaatagtacgcctaaaattggttgccgcattacataacttgtgccatgagttacataatcaaaaagtacaattacaattaaagccgatgtctgaatgtaaaagagaaatgaatccgaacgtactcttgcagcttttaatctttcatcagtaacttttttcataaatatcatctcctattcatttgttccaaaaagtgaattcaaatctgtgtttaaagcatgacaaatcttttgacatagtgctattgttggattatattttcccacttctattaaataggtagcgtcaagaatcttgtgtaaatgaaatgccttaaattttaatctagttttgtcaatcggttcatatcattaagctggtacatcttactcaacgataagccaaatcatgattgctaacccaacaatcccaattaagaacaacgcaactataaacattatcattggaataatgccaaaaatttttaaccacatgttatcatttctttttgtaatcaattctaagctcttttaagccattctatcttactcacgtatatttatattcaatttgttctaaaacgtcttagaacgtatctcatggctttaaattaacatgaaatcaatgaggatagaaatgcaattaagattatcccaactgataacaaaactaatcctaaaaatattgaaaaaaacatatattttcccttccagctcattttgtttaacttaggcctaccctaatgtaatcactgaaaacgactaattttattagttacaattaagtgttccagtggcgttcttaggttacccttcttatctatatcattgagaagtttctgtaatttctgatactcccgtgttacgcttattctcgttcctacattccattggaatattcctatacaaaaaaagatcatcaaagaagataccctcataataccttcctagatggtcttttttgtatcaccatttaaataataaacccaaagctaaggtaattatcccaaatacgatgaaggaaactagggctcctatcaaaatgctaaggataaaattgatatttttctgtgccaatttaacagacaagtagtccgcaaacataaaaaaatccaacccaattaggctaaatccccaagacgcacgaccagctaacatcaaagcgatacatattaataaaacaattatcatgacgtatggaatctttttcatggttgctaaactatattgcttagccaaagctactgtccaccgcgaattagactgcatttaaatcaatcccccttataatgggcctaaatttgaggaacaagccgtaaactcaagacttctcagcgcacacgtttcctacttttaagctagaccaatttctactttacatattcacgattataccaagtaaccttatccggtaccgttggaacaacactctgatattttacctttgtgaaaatttctgggaaacaattggtataggtattcaatccctgatttaccgggaaaggaagtttgtgaaatttactggtattactcctagaccattcccttaaattcaactgtctcattctttgtattaaccaaaaatttgccaacacttccccgatacttcactgatactttaaatgaatacttgtaatttactcgagtgtatcgaatactactaattcttccctgatacccttgactacgcaaaactctcttcacttggttcctttgtcgatcagtaattcttgcagaactccgatagattgtcttcttaacgatcacatctggattcaatggaacaatgtaattcttacattccaacaattccaccaactttctttttttctttggaatttgacttgacgggttacggttttccattcagtttagagggagtgacgttttgagcgcagaattgttccctggaatcagctatttggtatacgcatgtcatgaatagatgcttcaccaatgacattatgtccactatacagaaacaatcataattgtgatactaatagatttttcaatcttattctggattaattattcttgtaatcaaaatgaactaaatctctcaaacttgaacagagagtatgtgttcttgatgaattgtcttgtgatcctgaaatcgggatcatttttgatgtttttgtatatttgtttattgtaaaatattatgaggttaacgatgaaattaccgttgtatgcttccttctttgagaaggttgatccaattaatgaactaatattcgtgttgattccaatttctggaaggatgtcattaatgcctaaacactcaaagaatacatgatatgttcctccgctacctctgcaaaatgggcacggatggtagaattgcctattcatcattcctgtctgcaattcaaataactcgttcacatcggagtggctgtgattgtgtaacttactcagggagtgaaaacagtctttccattgctgtggaggtatgctcacctttgtatcccaatattgtgtattataacttcctttagacagttgatagtaataccgtttggagaagtggcgaaaggactcgggttgtatggcttgatctacgtcgaagatctcaactatctcccatgtttgttgcaaactctcgaccatcgacactagtgccgttgaagtgaagtccactgttggaattgcatccgtataatcttcaatactcgtcagagcgtaccaaccttcaagatatgacagtaagttagagtagacaaaaatcccatccagcgtcgtctccgacgcagcctgcatatcgtagtgagggggtctgtcaataatgaaccggatgtggggttccaggtccattattatttgactagtatccacgacaatgcgtctgggctttgttgcctgcttgaactctcctcgtgagagacaatccgcgatggttatttcattaccccatatatgatgactcttgtgaagtatcaagtggtaaggatatgtggagatgatatcgttggtaacagtaccaggaactttgataataggtagatggcttggaactgttcggttagccaggatgaacttcttgacatattgggagtaacacgtaaacgcgtagtgatttctgacggcggtattgatcaacgcctgtaaggagtgggagatgattttcgtcaatggatgttcgtgtaagaatccatattcgtgtttggtagtggtgatatacacaaagtatcctctgcgacctagcaattgttttttcaggtcaaccagacccattcccccattcctatgaggaaaatgccagttaatcctgttcaaggcgagtatcttgggcaaatatttcagaatttccgtcttcacaaaattttcgaaatccgtaatgagtgcatctggaatgggatcatgctgatcaaagaagtagattgtggagtataagtatgtgtttactgaaaccaccctttgatagagattgagatccataaataatgttttcctcaaacgatttttgagggattttagtttattctgccaatccattctgatgatgggaactcccaagtagttaggattctcttcgatatttcgaacgggtatttgccactcatgttgattgcaaaagttggtgattgtagccacgtgttgctgattgcaaaatatgatagatttattctcgttgattcgaagatcggagattagagaaaaatcttgtaataccttcatcgatttttggagttgattgttatcgttgtgaaataagcaaagatcatccgcaaaagcgagaacattaatgtggatattggggtccagttgagcttcagaataaggattgaaagtcattcctgtgattgtaatgtgaaacttactaatgaggggttgaatggccatgttgaagatgagaggagaaaaaggaagaccttgtcttacgcccctggtcagatatatgttagtgttgctaatcagtttttcgttaagaatattggcgtgtgccagaaccgattgtgttaacacagcttgtataatggatttaggaaatccgtatttattcaagagtatctgaatgtaccgatgatcaatagagtcaaaagctttcttcaggtccactaagaatatatgttgtatattgggagatgtggtggaagagcgtatcttgtgtgatagagctctagccgtctctatgtggagatgaatatttctatttgtcataaatgcctgttggtggaaggtgattaacctattcgcaatgggcataattctctttgataagctgaagttgatcagtcttagcgaggaattggttagactgatcggacgtagatcatcaattgatggttgatcttctcgatagctctttttgggtatcaatttgatcagtaccttacctataccatcggtttgccggagtttgccttcaaggatatagttagccaagctcgtgatgatcgaggctgcgtatgtccagttatttctccagtctctatacgtgataccatctgtaccaggtgatgaagggccgttctcatttaggcgaatcaaattacggtgtaattcatgctgagtgaaaggttcaacgagtgacgcttgttcttcttgcgttaacccttccttgatgtgttcggtgaattcttcaaacttgttgatggttgaattggtcgagtacaaatcgttagatgaaaacagtgaagagtaaaactcggttgccctggaaaccgtctcatcatccagcgtagcttctttcgagtgtttaccaaatcgcagtctcaatctcttgtaatttgttgacaagttctcagcgatattgtgggattgcgggtcagtgaaagcgaaccccgcggctgattttttggttctgtaggatgggaggaacttcatgattttccgcaccttcgcagttttccagcgcacacgttgcatgtatgcattgtagtcgttagaaggatccgttgtaatcaggtcttcgttagagaaaatgtatctggagaaatcatcatgttctaaaatgtattgtgggatggctggcaacctcttccgatagtttctgcgattgagatgaggtaatgtggtgttctcatcagtgtatgacaatgtgcattccactggcctatgggttgagaaaggcaatttagggtggaccttatatttgaatttgatttcctcgagcagctgaaaggaggtataaaatctatcaagacgattattagcccctcttgtgccatgattggtatagttgatacttctcctattgattgggaggaagaaaatgtcatagagattggtatcagagagagattgatgaaggaaggattcaatggggcttaagttggttgactccattggcttggtattccagtcaccacaaagaagcagcttagcccccgtctgtgagatggaggttatagtgtggcaaaaggcattgatgaaatcatttttgttgataatatggaatggattatcgtctcgattattgtagactggaacataaactgagaaaatggttagttcatgttctttgaacgatatggttatatcactcacataagggttggcagtcggattgaattggttgtgaatagaaaaagaattttgagttgtgatgctcaatgatgtatggtagacaattgctgtacgatgtcgagcagattgtaactcaattttgaaatcgaaattggatagtagtacttgaattgaatttaattcagttgagtggttcagatcaaactctgtcagacacagaatttgaatttttttggattttgcgaagtttaggatatgtattagtttggaagggcttgttgccttctgaagattgaagttgaggactttgagcttattcatgaggagcagtttgtattgactggtcgatatccatactggctcccttttttctcttttccagtaccatttccatcttcttcatgttgagcttattagctgtttttattcctttcccacttctagtaattctaaatggggttctcgattgagttggggtttggacaccttctggttcgacagacaattcgtccatggctgaattcctttcatgattgttttcgcaaacatcattttacagaaatttggccatgggccattctttatttaattagtgttgcacttaatttgacaattcaagtactatatttattaggaatctttaatagagattcttttttatttaactcccatgtgagtgtctttacgcatagttaataactgaaaaaagagttttttctgctaaaatattttcactaacagaacttatgttttattcgtggtttttaagcaaaattgtaaaaaatatatttcttcaaagaaataaaaagggattagtaatatcataatattactaatcctaatatcactatttgttttgatctatcaagaagaaatagccttcatttgttaattggctttggctaataggtgcttaaaatttttctctctaacgcttctaggaaggaaacttcgaatctcgtcttcgttaaatccgacttgtaaagtatttctatcaaaaataataggacgtttgatcatttcaggatgcttagtaagcaactgaataaactgtgataaagtcaggctctcgatatcaacattgagttttttaaatactttgcaacgtgtagatactagatcccaacaaccattttctgttaagcttaataataatttgatttcggacgcattcagtgctcgccgagacatatctctctcttggaatgacacatgatgttctaataaccaatgtttagctttacgacttgaagtactacttggtgttactagtaaatttatcattttaaattccctccttataccattaaaaagtgggcgtaaatatgattgggaacaactgattaattaatactaggttatcacatttataacaaaagtaaaattcttaaaaatttacataagcaaatctctaaatatttctgaatacgctttcttattttatatcacatttatacaatgctttcaatagaattttgttattgaaggcatatttattttactcctttttaccctgtgccaaataaatattattcgataatgatataaattaaaattgataaaatttttcaattggcaaaataataatggttgctcccccaactctagccatagtggggaaagattgtcctgatggatctccatgaaaattaattggtggattaacatactgatctctcgcagaactgttttctctaattaattttaatgttaattcaaattggttatctttcactgctaaaaaataagttgcatttccagatctcagaaagccaccattgcttgaaaaacgtgtggccggaattttattgtcaacaaaggccgagcgtaatttattagcatctttattttgaacaataacaataattaatcgcataagatttctcctttcatgacgtaaaagtggtcgtctaattgaatttattttccccaattaatttaaagaatgaatatgctatataatttagattcaattctacacttaaatattcttaaggtgaatttttatgtacctaaccaagaatatttcatacttaaaattcgtaaattatgaattattggataaatctatttatctaaataacgttaaacatatatatttttctttattaattgtctcaatcaaaaaaagagcattttgattaaaaaactgttattctgatgtcaatagagggaggcgatcttttgaaaaatatttataaattgctctacctgattattattatcattctatttccatttgtaattttcccattaatggcaacctgggctatggttactcatacgccatttcccatcgatttaactgcctatgattgggtgaatcggtatgcacccctatatttattctggggaagtgtggctttatcactcattttggttggcctttttctggtcattattttctggcatcgccctaacacgatgtacctgtatcagaagcctacgggacaattaattgtaactcggaaggccattagtaattttgttttgactgctttgaagcaagaaccctatattcaagaccccaaagttacgaccagattatctaagcacaaaattcgaattcgggtctcaggtgctttgttgtcgtctgatcaggccactcaacagggaaaagagtttattcagacgattgaaacgcgcttaaaaactaccttgggtctggctcctgacaagcagattagtattaagttaaatgatttcagccagccagattctcaccattcacgggttatgtaggaggtaaatttatatggcaaattattggcaaaaatataaatggcccattattgggggtggcttaggcttattaattgccattttaatcttaacgcttggcttttttaaaaccctgatcatcttattgtttatgctgattggcatcggcttaggctggtacttgcaacagagtaacttttttaataagttacttaaaagttggcggtaatcttaaggatctttacgtttaaggaggaattttattatgcaaaatcaaaaccaaattaactcaaccaaaactaatctaaagggcgaattgacttacgatgataaggtagttcaaaagatcatcgggctggcattggccaatgtcaaaggcctgctgacagttaatggcggctttttctctaatttagctgataaaatagtcaatagtgacgatgtcacttcgggaattgatgttgaggtagggaaacaacaagtggccgttgatttggaaattgttgctgaatatgacattgatatttctaaattatatgatcaaatcaaaaccaaaatcgtggaacaggttaaaaagatgacggatttaaacgttattgaagtaaacgttaaagtagtcgacattaaaactaaagcagaatacgaaaaagacgcggtcagtttacaagatcgggtggagaatgtgaccgataaaactaaaaaagcggtggataatcagaaagagaatgatgagtcagccgcccgggttaaataattaaaggagatgttgactatgggatttgtttgggcaattattgtcggcgctattattggcgctattgctggggccattactaataatggtaaatcgatggggtggattgctaacattgttgctggtttagttggatcggctcttggacaggctttgttgggttcttgggggcctagtttagctggtatggcaattattccttcattaattggagctatcatcttagtattagttgtttcactcgttgttggccgaatgtagaaagtaggtaacatgaatggaaatcatgaaaaaaatatttaaatttataattgctagtaccttaattattagtggattattattaggtggtactatattcgctactaagaaaattgatactttaggagacaaattgcaacaaaaattacatggataattagccaaatttatctgtattaggcttcttagaacgtaaataattgagcaattgaagatcagttaatcaatatttaaattggtgagataaccctttataaatatagattggaatttttttgataattaatcaaagcaggcacttttttacataggtgcttgcttttatttatctatacattatgacctagcagttaaaaactgtttttacagatataaatatagtattcttactgattctttaattttatatttggttaaagagctagactgcctgtataatagatccagtagagaagttaaggcggtggctatttccaatcggaggtggtgcttatggtgttaaacctttaaagcccataaatcctaacgaaaggagtagcctaggtgtccgtgtcggacgctttacaattaatgctggctttcggtacttttatcgtggccttaatcgcattaattgttgagctgatcaaaagtcagcaaaaaaaataaccgccttcttaagagattttagacagcttcttaacatacagttgcggtgttttagtgcccttgagatatttatctccccgaatttgccaatcgtcattggtattaatttgaaaatactctttatttagtaagccgccttcaaacttgtactttttgataattaatactgatcgggcatctcctttagctggtcgctgccagtaacctcgtagggaagcgggcgtttggacatatttggcttgggcagaggtgttagacaacccgatgccaataatgagtcccgttgttaataaaaacaaagtcaaaaattgatgaatcttttgcatggtattctttcctctctaaattgaactagtcgttactttaattttagcaaaagttcaagaataattctcaactgttaaaacaagatgaacgcaaaataatttcttcacaatgtttttgaaaataatttttattttcaaactattagtgagagtagaaatttcgagaattattgtttgcttttacctttatttggccttgttttaacttgaattttttggggattgtggttataacagagttgtaagcggttatggttcgagcgagtgaatgaatgattttgaaattccaacactcacatcaagtgcgatagtttcaaaaacttaacaggcgattagtataaattgtctgtttttactttaatcgtagttgctcactaattaacaaatatatgttatggagatgtgattatgcgaattaaagcagctgttgttaacaaaaaaggcgaagacttcgaaatgaaggatgacgtcgaattagcagatatgcaggctgacgatttacaagttcatatggttgccagtgggatctgccattcagacgaagctttacgaaaaggaactgccgaaattggttacccaatcgttcttggtcacgaaggatcaggaattgttgaaaaggtgggtcctgaagttaaagacttcaagcccggtgatcacgttgttctgtcattttatggctgtggcaactgtatcaactgtttaaagggaattccaacccaatgcttgaattacgcagcaaacaacttatcaggtgttcgtcctgacggcagtgcccactttaccgaagatggtcacaaggttgctgatatgtttgatcaatcatcatttacaacaacaaccgttgttcgtgaacgaaacgccgttaaagtttcaaaggatttggacttacgtaaacttggacctcttggctgtggctatgtcacaggtagtgggactgtcttcaatacgttgaagccggaaccaggttcaacaattgccgtctttggtactggtgccgttggattggctgctatgatggctggccgaatttctggatgcaccaaagtcattgccgttgatattgtgccttcacgtttggaattagctgagcagcttggtgctactgatgccattaacagtaaagacgaagatgccgttgaagcaattaagaaattaactgatggtcatggtgttgattatgcggttgatacaaccggtgttaagtcagtcatggaaggttcaattcaagccttggcacaaggcgggacagtcgctacgattgccgttaccgatcaacatattgatttggatacctggaatgatctttgcacaagcgatcgtaaagtcgttggtgttaacatgggtgattcaattcctcaagttgatgttcctcgtttgattagtttctacaagttaggcatgtttgacttcgataagaccgaaaagttctacaagtttgatgatatcaatcaagcaaacgctgattcagttagtggtaagacaatcaaaccagtcttagttattgatgatcagtataaaccaggagaataattccgttagtttaatttaaacgttcacataaaaattaaatttgtgcccgccaaaataaccgatcaatcttagttattgccgacaggtaattatcaaaaggagagatttattatgggacaaaatgctgtttcattgaagcactatcaaatgtatattaatggtgaatttaaggattcggaatcaggtaacatgttaactgttatcaatccgtcaactggtgagaagatttcaactgtcccagctgcaactcgtgaggaagctcaagaagcgattgatgccgcttatgaagctgaaaagacttggaagaaagtgccagctgcaactcgtggccaatatttgcacgatgtcgcaactgaaattcgaaatgagaaggatcacttggttgaaatgctccaagaggaacagggaaagatcaagtcattagcaaccaccgaaattatgttctctgccgactactttgactacatggcaagcgcctcacggacatatgaaggtgaaattcttcaatcagacaataagaatgaaaatatcatgattgctaagcagccaattggtgttgcttcaggcatcttaccatggaacttcccattcttcctgattgctcgtaaaatgggtccggctttggtaactggcaacacaatcgttatgaagccaagttctgatacccctaatttgggattggaatttgctaagattgttgaaaaagttggtattccaaagggtgttgttaatattatttctggtcgcggttccgttgttggtgacgaattgaccaagaataagaaggttggcatcatcagtttgaccggctcagttgattcaggcaagcgggttatggccggtgctgcaactcacatggcaaaggtatcacttgaattaggtggtaaagccccagctattgtttgcaaggatgccgatattgacttggctgttcaatccatcattgattcacgggttgataacaatggccaactttgcaacaactgtgaacgggtttacgttcaagaagacgttgccgatgaatttatcaagaagttatccgacaagatgtcagcaattacggttggcgacccgatggaacacgaagatatcggtatgggtccattgattaaccaagaagctttggacaaggttgccggaatggttgaccgggctgttaaggctggcggcaagatcactgctggtgggcacaagctcaacattaagaacggcttctactatgaaccaacagttattacgaatgtcaagcaagactctgaaattgttcaggacgaaatctttggcccagtattgccagtattgacattcaagactttggatgacgccattgaaatggctaatgacagtgactttggtttgacttcatcaatctttactgagaacttggataacgcaatgcgcgctgctaacgaacttgaagatggtgaaacttacatcaaccgcttcaacttcgaagctatgaatggatcacattcaggctggaaggaatcaggtatcggtggtgacgatggtcgtcacggtatcgaagaattcttgaatacccacgtcatctaccttcagggacatccagaaaaggctcaaggataatttgggatcgtttcagcaacttactgcttaaagaatatcgatcgttcaaaaataatcctctttggatttgcgttaattggtttgcctaagtaagtggcttgggcaaacaggattcgcatatcttcataaaaacggaagtttgtcaaatggtgttgagggatagtttctatcctttggagatctcctcgtgtgggagatctttgggaagtttgtcaaatggtgttgaaggatagtttctatcctttggagatctcctcgtgtgggagatcttttttgttgttttattagttgcggcctttaatctggtgtgtttgtaaaagaagcacttttgtgctcttgcgcgtgagggaaaatggaatgtaaaatgtattacacctcgaagaacgaggtaactcggttagtataaaaacctatataatgtatagaactccgaaatggaggcaagtcaagactggagggcgtagcacccctatttatacttgtagagagagatgggtgactttacgttaattagtaagcaatagtcacgattctgtgaactgacccttggtttatgttccagaatattctaccatagtgtagaatgtagagggaatttgtactagaagattctagtagattagcgacttttacactcccccgtaaatcaaacattctctcttcatttgacttgataaactcatccttctggtgtgatatgataatccgtttaatctttcatattgatattgaaactttcgtacctaagataattcctaatgtgagaataattcagtgttgatatggatgtgccaagatcctctgtattttaaaatgttaactgatgatttggtgattacttcatgttttgattgatatttctcacttgatacctgtcaacgtgcatgatatcttgttatattttccaattgtatgtattttccaattgtatgttcttgtatgctattgttgtttatttctctttagtatttgatgtcctttcgatttcaatgaattttataattcattgtaacaagtctctttaagctttaatcttattttctattcgataccatctatttcttgtttttctgatatccatcttcctattatgtttttccataatatgtgacttgttcttttgagactaaccctttcaatatcgttttcaagaacgataagactttcttcatttctaagcatgattgcttcttatagtggtgacttcgacttctggttgaattcttattatacgcacttctttaatcctttttcactcaatgtaattatgttaatagattaaatcttcaattgtttgctctttggctatgggaattgcggagcaggagtttaaagccattattctcccccgcaagtgaagattgctaacaggatttaatgtgcagaaagggtgtatagcatattgttcttatttgaactgttcagaactcttgttcatgttgatttgtaattgttgaagtaataaacgttgactgattgtttatcttaaatggttcctacttgattttgaatagtgttggtaagatatgagtaggtaggactaaccttaactctacatcgattgttgtgtaatttttgattgttgatatttcttttcatatcatttggcttctatggtttaggattcatgttggtatggacattgtttacgtgatgtacctggtttcgtggagcatgatacacgttgttgtgtaatcatattgttattaggatttgtaagctccaatgttatctgcaatagtaaatacttcttggttatctgctagataatagtgatggtaatcttgattgattggactgtattcgaaaccttcaaaccgttgattcattctcctaatttgtatgtgcttaaagatttttcaattgtgatgttgtcgcacgagtttattctcccattttatgtgcgacaaatgaatcggttttgtaacgtaaacttatttgaattgttgactggctgtgttgctaacttcagatgtcagtggtgctggtaagatggtaataatgggatattattgtacaatttgaatggtaaagcatcttatttgaaagaagtcgacttatttgatgcttgttgtgggttttgtatattaaccaattgatctgattcatttcattatttgaaggcattcatattttgtaatgatcaattgtaacttttgggtcttataatgttgtataagtatgcggtcattggtaactaggccgagaattagctgtgctaaatgtaacagtggattttcaaagatttgaaaagtggatttggtgttgagctagttgataatatgttttatcatatgtgtgcaagaaacttcctgatttgaatttcctagatttgaggtatctttttgttactagatggattatcaatgatgatgatcttggcagaactcttaggatttgaatagtatgaatttgtgtttcttatcttatgtatcaggataatttaatgattaatattcgttcagtggcttgcttcctgatgaaccactataatgccgaaggcgtttgaagcctgcaaaccacgaaccagtttcgtaaaacaaacgaatatccagggacaaattcataatctagtaaccttctaggattgtaagtgttttattatttttgactgattgagcgaggatgaaccgagaacattccactttatcacgcaagtaaagttgaatattgatttgactgagtcaatgtaagtgaataaggagctgactttgatgttcgctgagaacttgtaataataaaatacccttctttgtcgtcgcaatgggtttcaaagtcactttgttttaaacgtgccagttgtagatgcacatgcatatagaaaatgcatagtcctgtaatttgtaatttggacctttctccttgtaaattaatcctctaataatatttgttcatatcttctgctttttaattgttaacctattgaatgataagcagttttaatatttgaaatgatacctattatgaacaaaattcgagatatctggtaaactcgatataagctttatgtaagcttccctttattttgaagtagatttttgtgatgctcttgagtgaattgaagtctattaagatagcatcataaacttgaaactgtgtcaagtatttgtaataacatgattggatgttcgatctgtaccaagaagattttgagtaccaagaagttttgtgatcggttcgaactaatataacatccataaacgaataacatttctccaagtgattattctcctttttaagcctttttcttagaactattctttaagctaatgacaaacgcaataagtattagttctttgtgtattatttgcgttagttctaagtggatttttctatcctgagaaggttaggcatgacctaaagcaacgtatagccatcctaatttagtaaactgaagtctattaaaacacagaaggtgatttcaagttttctgtgagtcgatccaaaagaacctaccttctctttgccttcaccacaacgtgagtgaatatgtgaaatgacaaccattcattttgtaccagtaccgtcaacaattatggccaaatattatattctgcggaagatggaatataaggtacatgcttgagttaacttaccatcgttaaccataccaattgttatcaacaatctcttaccttgaaccattattaacagatgtaataaattctgtttgttgtatcaatgtcgatacttaatcgttgcacctattttcaacgataaactagcttctaattttgtttcttatgtatatgaaacgttctcatcttaattgattgaatcaaattttgatcaactacttcaatagtctatcggggataccctgatcaaaattatcggcattgtttgtgatgagccactgtgaaatctgttaccacttgatttctttttgtaatgttttccttggagtaaatttttgatgttgttattcttcatgtttcaaatttcaatgagatgactgcaaatgcattgtgagtgtagtcactgtggagtccgcatttgtaagtgtagtccctggagagtccgggactgtaaatctagtgcgttcacaaaggaagacatgtctttgcttagaagtagcatagagttgactggccattggaccacagcggagtccacatgtagaagtatataaccacatgaatacaatcaacatgcaatgcaaaagaaacttgaatatgtcctggtgtgattatccactagatggtacagtagatttcggagaagtgttcattactagcgccgaattccttctcccagtctccgaagtagcttgtctctgtaacctgttgccgttggcttctgctggggccccacagactggcactagtagtcctgtgcccacctccaggagcaactaaaggccacttgccaaatgaaaattcaaaattcatgctcggctcgactctcgacgggctgttgatttttgttgttgttgatgttgttgttgttgtctcttccctcttctctagctgcctctgcatacgctgctgcttgacggcacctgaccacacaacatcactaccaccactgaatcaatggtgcctcatgcccctattccagaattctgcgctatccacatgagcaggagggcccaatgcctgatctttacccgagatctggcaatcgttcatttttccagtcagtaatccgtctcatggcggaaggactctgtctgttcactgtgttgcgtcggctgttgacttccagctggtaatccgtctcatggcggaaggactctgtctgttcactgtgttgcgtcggctgttgacttccagtcagtaatccgtctcatggcggaaggactctgtctgttcactgtgttgcgtcggctgttgacttccagtcagtaatacgtctcatggcggaaggactctgtctgttcacgttctgttattgttggcacaatgtcgtagtagttgtagtatcatgtagaccgtctcggtgttgcgtggcacagtgtagcgtgcactggaaagccgttagtcctagacagtagaactgaaatctgtggacgcgtacgcgtttttggttacatgtactgacgggtcagtgaccgccaagagataactagtacttctatatacttgagtttggaggttgtactcgcgggagaggcaatgtaaagtatctcttcatcgaacgttggttgcgtggtgatttcaacttggatgttgatgaaaagctgaagtcgttacttgacttccctttgttctctatgtatcatattttatgctacataaggggcacaaagtacgacgtagcatgctactgctgtatagatgaggaataggtcgtgcggtacgtaagttcgctgtagagaaccctagcgttcattcatgtgtgataattgcagcaaactgaagcaagagagccttgagaatcgaacacagctctgccaagattttgatgcctccaaaccaaaaaaaaataccactgagctatgcagcgtttctttagtttctggttttgcttaggagtgaccagactgaatgaggaaaatcccatttttttggctttctgctcttttgtgtagctatttacaaatttcacccccattggatgcccttagggggtatattggcagcggaggttacagtgcaacacattttatgcattttcattattacctgtaaaaaaattcaaatgtaagggttcagtgtagaatcctttttaaaatttgtgcctttgtatctatagctacacttacttttaaatgaaatgataattgaaggcacttataaaggtttatctctaaaaaaagaacctctatttcaaaaggtatgtataagtgctttcagcagagatctgactgaatctgcaatggtcgaagctggagagtttgcagttgttttcggaacacttactgtatatagatacgggctgtgacagcttaagagagaatagatagaagatatagctacggtagtgtttactgaagcgcttgtgagtgttgcactcgtacagagtgcgagtggtagaaatatgccaccgcaaattcagtcaagcagcggcagtcttctgttgtagttgcaatgagcagctcgaactggcacttcagttactcactgggcagcgacaatgatgccagttaaatgcgttcgatgattggatgagaactcgtagagaaatcaaaggttaaagttggtgaagttcttctgtattaataactgatgttttcaatagcggctgtaagaacgtcacacacaaacagcagttctctttgtgtgattgccccgaccgagtagcctgtgtcagttccgggatcggtttaggactcagtaagttacacgcagttaggttcgaaggaagagtaatatgcgcggtcagcagtgcttcgttgggcttctagctagcactaggcatagtctgcttgtcgcagcggtgatgtatctgaagtccgtttggagtttggccaagccgttgtcgagatacagccatgcaaaggtggtaatagccaaaactaaaagtgaccatacgtgatggccacctgtgatatcaacaaccagctaacaggagggcatgaatttaagtgtatgtattgcgtttggtagtctcggtcagctttcatgtgaataggttgttgagatacgctaggttgaaatattgctgttttgtatggcagtggttgtggcgatcaactttatgtctccgatgtcagagccattggtactggactaaccttcagagatcatccattgcaacggtagaggtagcaatggaattcatcaactagtggtggagatagaccaggttgaagatttcaagtgtcgattatggctgttgacggatggggcccttctcgaatgctagtaagcccatgagtttcgaggtaggcctttgtatcatgccatcatgtagttcagtggagtgtggagtgctgggtggctgtgtgcgtggctatgtagcagtggctgcaaagaagagtgtaagcgtcaagtctgccgtcaagaccagtggcaaaaaagatcaacactttttctcagcgagctgcccatcctagtgggctatttcacgctttggttatgggcgtcaggactctggtctgggcaaccagaaactgtgaacagtaggtaatggtctatgaaatgtaattacaaaggactatagagaattgtctacagctgaggcagcatgttagcaaagcacttttccatacaaagttcgcattggagtgagtaaagaggagtatcgatgtatttctgatagagacagttcactacctctgagggaattgattagagaagagcgagttaaattgatgtcagttgagttaagagtaataggtgcaatggttgttaagtaatgccagttagaatttcatgcaaggtcagaacagacgttagctggacgacataggcagtgacaacaagtgggagttcaacactagctcttacatggttgagaagagcttgcaaaagtgtatcgaaatcaagtaaccaagaagaatagagcagtagtggtgaacagtaggcgtagttcaaagtttggcatgtttagtatggcagtgagctaggtgagttggcggctggcgacaagtagacgttcgacactggctcttataccattcagtagagcttgttcagttgtattgaaatcaagtaacccgtcatgataaagtagtagggttgaccagtagtgggtgttgaaagtttggcatgtttagtatggcaataataatggcgatcaactttatgtctccgatgtcagagccattggtactggactaaccttcagacaaccttagtgtaaacaccatactcactaaccgacctttggaaaccagccgacaaaagaacagagttgatggcctcattccagcagagtggagcttgcttcaatccatacaacgatttgttgagtcggcagacgacattgccaggagcagacacaccatcgggaaccttcatgtaaatctcttctgccaggtcaccattcaagaacgctgtggtgacatccatctgatgaatttgaagaccaaactgagcacacagcgcaaacacaattcgaatgctatcataccgaaccacaggactgaatgtttcaaagtaatctagaccgtacacctgcctgaagccctgagcaactaaccgagctttaaaagttggaggcgaggtggtgtccttgatagtgaagacccagcggcacccgattgcacgacgaccagcaggaagattgaccagcgtccaggtgccattagtctcatgagcctcgagttccttctggaccgcaccaagccactgtgctgaatgaccggaaccaagtgcctgttgaagagtgttaggcaacgaggaggtcacagaagccgctgaagaaaaggcttggtggatggcgttctgagcaacaaagagagaactgtcagtggaggtagatgatgctgaggacgatggagacaaggcaacactagcaggagctagacgtggtctctgagttggtggaaagatcacagatgagctggagctgtcggtgcggacacgacgaagaggaaggagcgatggctcaagaggaacctggtggatctcatcgtaaacagcaacgacatcgtcatcggcggcagccaaggctggagcaatatctgtgacggtgtcagatggggtaggtgaagctgatgcagttgaaggtgaagctggtgcagttggcgaagatggtgcagttggtgaagatggtgcagttggagatgaagaagttggagcgctggaagatgaagaagttggagcgctggaagatgaagaagttggagcagcggaagttgaagtagatgctgcagttggagttgaagtagatggggtagctggagcagacaatggcgaggatggcgaagaagagtcatcacctgctggagtagctgatcccgaaggaggggaagatgcaggtggaaagctgccaacaaagggcataccaccagctggggcgccgaagaaaacatcagagggagagataccaccatgggcgcctgtttggatcaattggttgagcgggttcagcattggaaactggctatcgtcgaaccgaacattgttggagacaatgacgtcctgaagcccaggaatgaagatacggtaagctttgtgggatgcactgtagcccaccatgataccaggagctgaaaccggagcaaaaatattgggtctcttctcaggtggaataaggaccatgcaatgacagccaaaaggatggaaaactgaatagtcaggagcatatccgtgccacttttgaaatggagagacgccagataagaccctggatgggtaccgattgatcaaaaactcagccaccttcactgcttcggtccaaaacttagtggaaagccccgattcatgcaatagtgtgcgggacttctcctgaatagtcctatgcttgcgctcagcaacaccattttgtgacgaattgtatggaaccgtgagctgatgagcaatacccttatccataaagtatgacttcaagttggcattgcagaattcaccaccattgtcagacctgacagcagcaaccttcaagttgagtggactgaagaaggactcagatgcagtgatgaaactcttgagggcatccgcagcgttcgacttcttaaccagaggaataatgttggtccatctggtgaagccatcaacaattgtgaaaaaatacttctcaccagccaatcccggaaccgaaataggaccacagatgtcaacatgcagaagctgcaatggagcagtaggggacgtggttgccatccgtggaaaggttctggtcatgttaccagagcagcaatgggtgcacaaggtagcttctgctgttggggagtagccgagggcttgcataacagcaggaggtggatgaccaagacgggagtgcatagtagccgaagaagcattgaccgcaaaactctgttcaaccggatcaggaacaacaggaacaaaggtgaactggtacagggtgtcttcagtgtaccgaccgataatggtaccatcattcagagtgcagacgtcatcagcgaaggacaaagcaaaaccactgatgttggcgatcttcttcaccgagataagattccgagtagcatctggaacataagcaacattgctaacagtgatgaaagtgttgtcagggccactgaataagatggagccataacccttgatgtccaacgcagtatctgcaataccattaacactaccagtggaaactggaacaaagtcttggaaatgatctctgttcttggaaagatgaagagtcgagcctgtatcaagagtgtacatgtcggaattctcatcagcagcgtgaacagccgaccaggagatgttcttcgtcggcgcgacctggggagatgcagtgccagtggaatcaggcttagcaactggtgcaggcgcagtgcaagtggtcgaagtgtggcccttggcccagcatcttctgcaaatcaatgagttggtggtagtagtcttcttagcatgagctttggtaacaaacaccttggaggattgggatggcgcagtggataaatcgcgcaaggcattctcaacggagctcaagctcaactctgggttagaaacatccaagatgcgggcagcagctgagggctcgttgaaggtcttcagataaacaagaccgaaaaggtgatcaatggtcatgccatgggaaaattgggctctgaaagtcttaagaaccttcagtgcttgggatggttgcatagcaggaacctgcatgaaagtgccaaccatcttggaaagttgccgtgccgacaatgtggaaaagttgcggcggatagcttgtaaaagttcaaaaccggacaaaccctcacattggaaatttgcaatgatttcggcatcaacggtggtaatcaaaaccacttggagggcccggttgaggtagctcgaaagctgagtgacagttaattcatcgatggagccgtcagttggaacgagtaaagacccgtcgacgaaaaactcccaaagaccgaggccataggggaccaaaatactttggatgcctgcttcccacgtgtggaaattctcagcagaactcaattggagtgtagagttctttgggcacatatgggcaaaactgctcataacctgttgaattgagactatcctagtattgatatccattgtaatagatgcttgttctgtgttaaaagaaactaaataaaataagtatataggaaattctacaataagggaaggaaaaggggagtccatagaaggtggggggacacccgtttatataataaatctgagaaaggaaattgaacaccattcggtgtagtggaagccgtaattccggttcggtgtacggaaacccgacaccaaccacacttgaaagtttggtttaaccgtcatacgtcaacaccctaccataaaccaaacattcaaatgatctgaacaccaataagaccagtgaaacctttgaacttgagtctgttggctaatgaaaaagtcttggttgatcggtcaaagtcagggaaagttcggccgtggcgggagcgcaagttagagaacttgcagtatggtgactatttacaaatattgcattataagaaagctcatcgagttaaagaatgtggcgaagttttgcgttttgtggaagataaaaatggtcacaagaaattggcgcagacttggttttgccattctcgtttgtgtccgttatgtaattggcggcgggcaatgaagcaatccaatcagttaacacagattttgacggaagctgttaaacaacgaaagacgggccggttcttatttttaacgttgacggttgagaatacaactggtgatcaattgaagagtgagttacgtcaaatgggacgagctgttgcaaaaatttttcagtatacaaaagttgccaaaaatttattgggctatgtgcgttcgactgaagtgactgttaatcatgaagcgggtcagccaatgtaccaccatcatatgcatgttttgctttttgtgaagaaccattattttaaggggactgataactatatttcacaagtagaatggactgggttttggcaacgggcaatgaaattgacttatgtaccaatggtgaatgttgaggcagttaaaccgaatatgaatcgccataaaaattcgttattggctagtgctcaagaaacggccaaatatcaggtaaaatctaaagatattttgactaataatcaagaacaagacctacaagtaattgatgatttggaacgagctttggctggttcccggcaaattagctatggcggtttgctgaaagaaattcgcaagcagttgcaattggaagacgttgaaaatggtgatttgattaatacggatagtgatgatcaaaaggttgatcaagtggtgcgtgagattgttgctaaatgggattatcagcgtaagaattattttgtttaatgatttattgtctatattataagtgaggggggaggtgattgctttggcttcatttttcaatgccttaaagggattgtttaagggaatgattaagggtgcttttaacttttttacaggaaataaaaagactattaacagttcgaaaaatattaagggaaatttcaatggtaataatatcgataattctagtgtcaatgttgataatagtgaaggtgagaagcatgaaaagaagcaatcagaccagtcaagataattgttctaatacttcttctggtaattttaacggtaataatattagtaattctgatgtaaaattcatttctggagttacaaattatactgataattctaataagtttgttgttttgcaggaatttataaatagtttttttgagaaagctggagcacttcataataaaattggagaatgtgccggtaaagattctattcctgatttgaatagtgatttactagctttgagaaattttgttgaaggaactcttgcaattccaaatagtatttttgaaatagtggataaaatcgtgcaatcgttgttcgcttactatgaattgatagctactcgaggatctggtaataatcttagaaatatgagtgctgatcaaagagatgattatattagagaatttgagaaaagaaaaactgaacctgtagaaattcagagaagacttttacatgttttgagaaattttatttttgatgaacattgttaaggtattattgttttaaataatcattgggagcaaaagcgacctttgattatttttttgccagcggcaaaaccggcctcgcagagcccacactttacaaggtaaagtatattgggctataccttgcatggaggttttccgaattctatgctatgctctaaccaaatttagctgtttggaatggagtggtgaaatgagttatttagtggctaatatgcagaaattaaaagctgataatttagttggcttgggtaatcatgatcaacgccgaacgcgacatcacaaaaatactgatattgacgttgaccgttctgacttaaattatgatttagttgctggtcggactaaccatttcaaaacggatattgaggcttatattaacgagcataaaaccagtcagagagcggtcagaaaagatgccgttttagtcaatgaatggattatttcgagtgatagcaatttctttgccgatttgacggcggctgatacccgcaaatattttgaaacggcgaggaattattttgctgaaaaatttggtgaagaaaatattcgttatgcaattgttcatcttgatgagagtacgccacatatgcatatggggattgtcccttttgatgatgaacataaattatctgctaaacgagtatttaatcgcacggctttgcgagatgttcaagatcaattaccagcttatttgcaacagcatggttttaatattcaacgtggggttcaagaatcggaacgaaaaagtttaacggttccagaatataaagctatgcgtgaagatttgaaaaaggcgacgcttaaaaaacgagaaatacaagctgaacttgaagatgccagaagacgccttgctgaacttaaacctcgtgatcagcaggaaattgagagcaaacctacttttttaagcaaggataaagtggttgttagaaaaagtgatcttcatgacttagaatctcgagcagctgtcagtgatatttataatcaacaacagaaccgtttaaaacttgataatcaaagcctgaattatcaactgcttgaagttaaagacaataattatgagttaagcaagaaaaatgagaagctccaaaaattagtggatgcgttacaaggaattgttcggagcgttgaccggttcttacagcgcaaattaggtgttggcttaccaaatgagtggctagagcgagctggattaaaagaaccgtctaaaaaagcccctcagaggccacaagagcgttcagagggacaacatgatgaattagatggtccaagcctttgaatttggtctatggctttaatttaaccgctgatgagtattggagctgtttaatggccgtcagtcaacggtaaatcgaattaaagggacttactgctttagcagttagtccctttttgaggctttaaggagttgattgactaaccaaacccagacactgaattggctgaaagccaaagtttcctaaactttgctttcctgcctcacggcgagtgcggggtgagtttgagcgggagctcccgctcatttatgcggtcaagctggcacagcttggactgggttcggggcgtcagcgcccgagggcttagaaactggtcgattttgaccagtttcttcttatcttgatactattagaaacaacgtcattttcaaaaagtgaggtaaaccattgacacaactgggtttaggcgtattattgtggtataaaacaaatataaaaaaaacccacgtgagcttcgaaagtttgccgacctcgaacgcgtgagttaatcttgtaaaaatcgtatttggatttactagacatagtttaaagcttgaaccctttgccgtcaagccttctgactgatttaagtgaagcaagtacataacagattaactcttctcacgtggccagatgagaggagtttttattatatctagtagtatctatttttttagtatagtctagattcacctgcattttgtcctgtccgctcgtggcaagggtttcaacgtttttttgtcgggctgtcattttgtcctgtccgctcgtagcaagggtttcagccatctcaacatttttttgtcgggctgttattttgtcctgtccgctcgtagcaagggttttagccgtcgtttcgttaaaaccatgtttagtataaacatctttagcggttacttctaagtctgataaatatagcctgttgggtaagttctttttctttttcgggtcaaatcccatttttacttgatacaataaactagcttcttccaattctcgttttactcttccaatttttcgatcattccaaccaaaaatttgattaagttctcgattagtaaaaatgaaatatacgcgtcctttttcgtcgatccaattattgtgtaaggaatagtctaaacgatcacgtaatatcatatatcctaattttgcactgtcacttaattctttatattcttcaccgtagagcaaaacttgtgggaattgaaaaaatctcgttccataagcttttttagattgaataaaattgaaatttgtttgatccattatcaaaactccctttcttgactgacacacgctatctcaaaagagagttgctaaaacatttgatttgctttaaaatacaaatctgatatgctctaaatgaattacaaagctttcattggtctggcggctttgtaattcatcagtatgtgtctgtttgtgagttgcccagtcggcaacttttttaagttctaacaacaaaaaatggactaaatagctctggttagctacttagtccattgactttaacttgtttttaattatccttaacttgtcctttgggactggtttgcggtataattaacctacagattaagaacaatgttcagtcgatttttacttggcggtctaaatcgactgaatctaagtagctatacgacagctacttgctaagcctaaaatccctgattcctcatgaatcggggattttttctgcctagctcgatctattattcggttgttaaattactttaaatttagaatagtgttgtgttctctagctgcaactttatttaggctacgtttgtttagaatgaaaccaatacgcgatagaagatatcattaaacactcctggatggttaagtaagtatctatcgaaaacaattaaaatcaagagaagaaataagtgatgaattacataaggcgggcttgggtgtcctttcagttgtattgaaaacttagtactatcatggacatggtgtgctaaatgagttatgcaagtataagaaccgtatgtctgaatttaaagcttttttcccccccccgataatttttaattggggtttttcttattatgtttaaagtgtaatcttttcctttaaaaaaaacaacaaaaaaaggaaaaatatacttttgacaaacactgatataatcggtatatttaatatagtcaatatactaaatatatcaaatatattgactatattaaatatatttggaggaaaatgatggggaaaattattgttctaactaacttaaagggtggcgttggaaaaacaaccgatactgatatgatggcgattgttgctgccaaaaaatcattattcaataaaaaagtcttattaattgatgttgatttacaagcaaatacaacatcaaatatgactcgaacatttggaacagttgaatatcctcagtcatttacaaaggccgtacaaagtggaaccttaaaccaagctatataccacttaacagataatctcgatcttatccctggttcccaagggacacatgaccttaatgaatggattttagataattcgaaaactaagcgttcgcgctacatgtttctaaaaaaaatgattgatgaaattaaaaataattatgactatatcttttttgatgttgcaccttcaacagataattctgtagatgcgataacaatgacatcagattacatcgtagctgtgcaagaggtaaaaagattcagtatggatggaactagcatgttaattgatacctatctacaaccaatgctgaatgcatttccagatgatgcacattttcaagttgctggaattttaccaactatgtttcaaaccaaacgcaaaaatcaattagaaaattatcaaaagactgtggatgtttatggaaaagacaatgtgttttctacaattataaagaggcatgatcgcctagaaggatttggggaacaaggaatttcactgaacgattatgaggatcgtcgaatgtttgctttattcgctgacttatttacagaacttgaaaaaagaattgcttcatttgaaaaatatggtgacattgttgatttctcttatactcaaaaatattatgatcctctaaccaataaaacactcccattaggaaaggagattactccaaatggctctattgaataatccaaaaaacaacaaaaagccgagtgccaaagatatcaaaattgatgacgacgtaaaaattagttacggtgataaagcatataaagcgcgagatcgaaagcctgtacaggtagatccgccagtactcagaatgataagaagtatttcatatgccaaagacataccaatgtatgacgtagttaaagtagcaatgcaggcatatttgaacacgttaagtgaaaatgaacgtttactgtatgacagaaggaatcggaaagtatattaaatatatttaatatacttaatatacaaaatatatttgagtgcaataagcagcatagtgtacaagatattttacgctctcaactgatgacaaggtgcaatgtttttacgttaattaggctcattgcctaataatagggggagctgatttacgtggaatttgaaaaacgactaaggtattcctcgatagggaacgcccaaaacgataactttaagggcttttacgctattaattggtctactatgttataatcattattgattaattggggtgtaccccaaatgagcactttgtagtatggtagattgcaaatttaatccgaattttttgacaaattggtcagcatgacctgataaggtgtttgccagtcgagtattttaagcggtctctggttaatttggagtaacgtcgtcgttaaagcttgagcactaatgtgctcaaaacgagtccccttaggataaaaataatgtaaattccgattaaagcgttcattactaccacgttcagttggagtataagcatggcagtaataggtcttaataccatattgtgattcaaatgatactagcccactaaactcagtaccacggtccacaataaagctgtgcaccgggccattaaaagttgttaggaacttagttagtgcttcaataacagtcgctgtcgtccgatcttttaaccggtaggcccaaccgtgatttttgatcgattaaaggtaataaaactgccttactatgcccacgagggccaacgactgtatctagttcaaaatcaccgatgcgattacgttgattaaccaccatgggacgctgttcaattgatcgccccaatgttgttcgctgatgaaactaatcgctacttgatgttggagcttccacacggtgaagtaccggaatacacgagtcaaatgatttttgaactacaagcggcaggaattacaccagtaattgttcatccagagcggaatcatggtattcaaaagaagcacgagttgctctatgattttgtagctagcggttgcttgacccagattaccgctagtagctacttaggcgtttttggttccgaggtcgaagactttacgcagcgaatcattgatgccggcttaggcttcgtttttgcctctgacgcacataacctaaagggccgtaatttccgtatgcaaaaggcttttgctaagctagagcagcataatggggcggagatggtcacttggatgcaagataacgctaaaaaaatcattaatggtgatgacctagagccgagtgagtaccaccatattaaagagaaaaagaagttttggttgtttagataatagttgaatttggaggaaaaataattgagtaaagttttagtgaccggtggtgccggttttattgggtcaaatttagttgatcagttaatacaagatggcgatgaggtcgttattgttgatgacttatcgatgggcttagccagtaatatacctagctcacctaaagtaactttttatgaacatagtattactgatcatggctttatgaaagacttattactcaaggaacagttcgactatatttatttattggcagctattgccagtgttgctgactcagttgcgcgaccatatgaaacacatcaaatcaaccaagaagcgaatatttttattttagagatcattcggcaacataagttacctattaaaaaagtgttgtttacctcgtcagcggctgtttatggaaataatcctgaattacctaaacgtgaggactcaacaattgatccgttgacaccgtatgcaattgataaatttgcaactgaacgttttgtaattgactatggaaaactatacaatattccaacagtggcggtacggttcttcaatgtttatggaccacgacagaatcctaaatcaccgtattcaggggtattgtcattaatcacgcaagcagctaaacaccaatcggcatttacaattttcggtgatggtgaacaaacgcgtgattttgtctttattaaagacgtaatccaagcattatgcctattgacgaagggtagcaacatcgtacatcaagtttttaatgttggtgccggtaaacatactagtcttaatcaagtaattcaggtgtatgaacaaattattaatcgggagctacaaattattcataaagcagaacgggtaggggatatcaaacattcatatgcagatattacacaattaagaagtttaggctatcagccgcattatgatattacgactgggttaaagttatattgggaatcgttaacggattagggggaatcttatcatgggaaacaaaatcagtcatacacaaacagtagatgaacatgattttgtagctaaattagatcgaccgtttcatcatatctatttaccatttaagcgtttattcgatctaatcttcgcaacgctattgatgattccagcctcaattattattttaatttttatgattttagtcaagctggaaacacctggtaaatgtttttatacacaagaacgtgtagggttaatgggtcagccatttaaggtaaccaaactacgatcaatgtatagtgacgcggagaagaaatctggtgcaatgtgggcaaaaaaaaaagacccgcgagtaactcgagtcggccattttatgcgtaaaacacgggtggacgaattgccacaattatggtcagtgatcaaaggcgatatgagtttgattggtccacgaccagaacggccaatgttcacgcaacaattcagtgaagatattgaaggttttgagcaacgtttattggttaaaccaggtctaagcggttatgctcaagttcatggtggttacgatgatacgccagcacaaaagcttgttaatgatatgtactacatagagcattttggggtattgactgatattgggattttttttgaaacgattcgtgttgtagtgaccggggatggagctaggtaatggtagtgaccgaacagccgttagtttcaattataatgccggcgtataatgctgcacgctttattggagaaacgataaagagcatacagaatcaaagttatatattttgggagttattgattaccgatgattgttcaaccgataatacatttgagattgttcaagaatttatagcgaatgatgagcggattaaactatttcaattacctcaaaactctggagccgcagttgctcggaacaatagcatgagtgaggcaaatggtcgttttctagctttcttggacgctgatgatttatgggaaagtaaaaaaataaatacacaattgaattttatgcttgataacaatttagcatttacgtttactagttacagttttcttgataatccaagtaatattgttgaagttcctgaacggcttgatttggcaggcatgttaaagaatactattataggtacattgacagttatgattgatacggatatgaccggtccttttcagatgccattggtaagaagagggcaggatttactaacatgggctaacttattaaagaatattcaatatgcctatggaataaatattcctttatctcagtatcgtacagttaggggatcattgtcgaataataggctgaaagctttaaaaagaacttggcacaattactataaagagttacatttagggttaccaaaagcttcattttattttttttgttatgctttgaatgctttgagaaaacattataaatcttgagtattgcctgaaaggagatgctttttttgcaaataggtcatttagtttctggacttaatataattaatcctttagatcaagtaaacaaaatgaatatattgacgaatgctattctaattaatcagtcagataggtttacatatgatcggtttcaaaatggcagggtagggtatgatttctattcatttgatgagcgtggggtaggattaagtaggaataatgcattgatgagatctcaattcgacatatcaattatttcggacgaagatatggtatatacaaaagattacctagatattatacgtaaagcttataaaaggtttccgagtgctgacatgatagttttcaatgttcgtgttcatgatcaaaatggtattcatgataaagtcactagagtgggcaaggtacactcttggaatgcattgagatatggtacggccacgtttacgtttaaaactgaagtaataaagaaaaataatattacattttctttattatttggcgggggagctaaatattcttcgggtgaagactctttatttatttgggagtgtataaataaaggtttgaatgttatttcagttaatgaaactattgctgacgtgtataatacaaactctacatggtttgatgaatgtaagctgatttctgagacaacttttaagagagcgtataatgaataaatcgtctctcgaccgcttaaaatacttgactggcaaacaccttatcaggtcatgctgaccaatttgtcaaaaaattcggattaaatttgcaatctaccaattagacgagatggtctcaacaaaagcatggattttcgcaatttaccaaatgctttagttcaacaagtcagtagccggcgtaatcatattccaagaaaatcattaaattataaaacaccaattgaggtattcatggaaaatatcacagataaacagttatgttatttctaacttaatttgacatttcaagattgtaaaataaagaagccccctattcagaggacttcatggcttcaccaatacgatttgacggagacccaaaaagagttgcaatttaaatttgcaactcttcttttcatcaactattaacttaattcttgtttagctggtccccaaaccaagctagatgaaacatgagcagttaatgttgaaccatatagagcattttgattgtcattaacaaaattccattctttctgttcactagattgaccctcactcaaccaaaactcgtaatgataagcttgtccatcggttgaataataagtttgactgtcaattatagcagtggagttgccattaagttgagctgcaattttgttcaattgcgtcgttccaattttcgattcccatttacctgttaaagctgaatctgaaacaccgctagataaatttgtatcattggttgccaaaacatcccctactttaagggtaccattttttagtttgacgccattgtcgtagatgctgtcaatttgcaaattaatgtttgaagtcgatattgttggcgtttgatatccggataacattcctttataaacattcaatgattgcaatggatatcctaaatcatcaaaaagcgatacgttatcccaagttgttccaccccaagctggctttccattgcagtacataacattgtttggagcatacccaacagcatattttgaagcccaacccgtaccatacaaatcagacatttcatcattataactccaatttgaccagcctgctttaactggaatccatgctggttcccaatagaaggcacccaaaccattttgatttacaatagcctgatacatagattctaactcatcaacttggccttgaggactgttctcataggcatatgaagattgatttgaaccaatagaatttcctgttccatcagcatcctgtaatgaatttgtccaacctgtttcaagcactacaaattctttaccaaaattatctctcaccattttttcaacagcttctagattatttggagtatttgcacctttacccaaaccatttccattattatcattggttgaccaaaaaggataataagaagagccaagaacatcataatctacattgttattctttagggcagtcattatcgttgaatatttttgaacatttggtgtttcaagttgaataactacctttgctttaggtgctaatttacgtacagctttcgaaccggcatttaaatatgaacttataattcccgccttctggttatcattccaaatgttagtataagactcatttgcatcacgactagcaataattcccagaacaccattcgtaatttcatttccgatttgtaccattccaatttctacacccgtctctttgaaatcagaaattgtttttctggtatacaaatatactgattcagcaatttcagcagaattttctttttcccaagcttttggtacaacctgcttacctggatcagcccaaaaatcagagtattggaaatcaagtaaaaccttcattccatattttgcagcttctttcgcaatttgcaattcattatattcgtctgaagctccaccactataagtctggttttcagcattaagtggatcaacccatagacgcagacgcaaataattaacacctgcttcatgtagaacttgaactaaatctgctggcttaccattgtagtcgtaaaattgaacacccgcattttgcaaagcaatgtaacttgaaatatcaaccccgcgaattgtatcatcagtcataccagcaatcggttttactgtaacaccttcataccgcaaaccagtatctgttccatttttatatgctgccgtaatctgatcagctgtcattgaactcgttggtactccagtagcagttgttgtcgaatctgagctcaccggttttccccaaacaagcgttgcagttaattgaattaataattgatcaccatattttttcccagtgttaattgacacaaaattattttccttgtcggtcgctgactggccagctaaccaaaattcataatgatacggattaccttggctatcataataagttttatttccttcaattgcgcttgaactgcctgaaagtgtttgataaatattttctaaatcagtttggctgaactcactatttgaatttccttgtaataatttttcaggaattgttgttgttaagttcaaatcagacgaactgactgactgtttagcttgaagcggttcagttacatcattagttacgccagcatttttataggtagcagttatttcgtaactagttttcgaagtaacagaagatgtttgattagcagtgtcttgtcccggacgatataaaacatacgctgctacccaactgtttttattagctaagtcgataattccgccaacacctaaagattgccagttagtatccttcaattgatcttgataccaatccataaagtcagttgtgccgttgtcagctgctatttgaacagtatctccagttatatcagttgtgtaaactgccacagttcctgttagattatcattttctaataaattttgttcaacagcttgatcagttgcattaaggtctccttgcgcaactaattgtgctacatcgtgtaacgaaaatgctaaatagttatcctgagtattttgccaattaacatctagtttttgattcaatttttcattaatttgctgagctaaaagattcctgaaagccattaacctttctaacttaccctcatttgaaaaatcaaaagtcgttccagcaattttaacttttccggttgccattgatccgttaactggatcaaagtaatattgatcattattaattttctgccaagaatattgcatttgaccttgtgaattataataaactgttttattttgctgtgagatatatttaaaaccagtttgcatcgcaccagtcttttgatcaaacaaataccagtgaccatttagatgttgctgaccatattgcatttgaccattattagcataatagacggtcttatgctggttagtaatcttctgaaaaccagtttgcattgttccatgactgtcaaataaataccaatgaccatcaattaaattttgaccgggtgatactttcaaagcgcctgttttttgattaaagttgtacctttttccatgaataagttgttgaccatattgcattttgccggtaggatcgtaatagactaacttattttgtgaagtaataaattgaaagccggtctgcatcgcaccagtcaaaagaattcacagaccattgccattaattgataacgtttttcagatctcctgataaatatgcttttatattatcaacagtcatatgcaacaaccgttctcttgtctcatatggtgcccaagcaatatgtggggtaatataacaatttttggcctgtaataatgggctatcactagcaatgggctcccctttaacaacatcagtggcgtaggcataaattttgccttcattcaaggcattcttgatgtccgcttcattagccaatttgcctcgggccgtattcaatataataaccccagttttcattttggcaatcgtatcattattaattaaatcaattgtttctggtgtttggatcacatgcagactaagcacatcagattgccttaatagttcatcaaatgaaacctgctgaatccacgattcaggaacctttttaggacgatgattatagaaaataactttcatagaaaaagcgtgtcctattttagcaactttttgcgcaatatggccataaccgattagtcctaaagtttttccttttaattctaatagcggtttttcccaaaaagtaaaatcaggagcctgtgcccaccggttttcatgaacaagctgattatgcaatccaacttggctagtcacttctaagaagctgtttagtatctttgattttgaccaaataatttgataaactactgtcaaaaaagttggtgatcatatgcaacattttagtcatcattaccaaagcgatatttctcggcaacaattcgatttgatccgtcaggatctggaagcttcaagaaaacgaactcacccaaaacacattgatccttatgatatcttctgtgccatgctctatgtccttaaaaatggctgtacttggcgtgatttgccggctgattatccaaagtggtccaccgtttactactattggatgagttggtcaaaagcccccacccctgataaaccagctttattaactcaggttttaaaaaaattgtcgctgatcgacgattaaggcaagggcggtcagcccgaacttcgttcgtcattttagatgcccaaagcattaagaacaccgctaccgctgaaaataagggttacgatggtggcaagaaaatttccggcattaagcgccatttagccgtcgacatcaatggattcccgcaagctatccatattacccgggctaacatcactgatcgtgacggggcgattgcactcgtcacccttaatttagagcagtttaaattggttcgaaccatgatggttgatagtggttataccggccaaaattttgccaatgagattagcagtttaacctcagccaaggtaatcgtcgttaaaagaaatgagttacaccaattttcggttatcccccaacggtggctcattgaacgttcatttagttggttgggaaattatcaccgtttatggcgtaactgtgagcgtaagctcaacactagtctcatgatggtttcgttagcttttatcaggttacttcttaaaagatactaaacagcttctaataataacgagaaagtaaattgtgccactgcgtcacttgcatatgtgggaatgttagtcaccacaaccttgttctggtgtgcgctctcaatatcaacgacatcataaccggttcccatgattccgatatacttcaatcgtgatgttttgctaatcacttcatgatctagcggtgttttgtgtgtaatgacgatatcagcatatttaattcgttttatgatttcagcgttatcgttaactggtgtacgatcatataaagtgcagtcgcctaatttttgcaagctttgccaatttaaatctttgtttagttcatatccatctaaaagaacaattttcatagtgttacccccccctatcttttcaatgttttagctgcattatgttctggttgtttaattgccgggttttgttcagaaaatgcttgcagttgtttttgcgttcgattactgatttcatggtgtacatcatttaacttattttttagtcctaacttttgttgtggattagtcgcttgctgaacttgttgttgcaatccttgataggacttattaagatcatgggctgatagcttttttagattatgctcaggctctttttgggcttcttgtaagcctaattgtttggttaagccatcgctaagctcaatcactttgttgctcacttgctggatctcacttaaagcactatggatcacggctttatctttggcccaggtggccacgtaaccgagtgagtagttgctggtatcaacgccaatattttgcatggcaacatacgcgatcgcttcggcttgggtttcctgataggctcgtggccgatctttaaaggctgattttaagccgtgtagctggctatgcgcatattcatgatataacgtcttcaattttaaagcattatcgggctcatcgccaccaatgacgatttcattactgctgggttgaaaataccccttagccccatttagcgtcgctaaaggcacttcactgactttaaggtcggtttgctggtttaaataatctttgaacgcgttatacaagctcgttacattctgatgatcggctaaattttctttgacaaaatccttggcacttaacactggctcaccgctagtttgtgacacgtcaaagacgggtagataacggtaaccgacaatggcgcgttcatcggtggtatcaagacgcttttgctcggcttgggcgactaattgtgctttccaggctttaacgtctgctttactcggcattgtctacccctcctcattttcaaaaatatcattcaatataggggctacgttgatttgaatcggggtcgtgccataaagggcaacgtaaccgtcagacaattcttgccaggctacttgataataagcgccgttaccagtgatttcttttaaatacttgtaggttcctttagcttgcaaaacgggtaattcactggctaaaactgctaattcgttgttcattttatgatctcctttgctttgctaatctcacccgttgtttgggtttacttttagggttgtaaaagtgaacctaaatgacgggttcactaaccggaacgtagtgcagggcggtaggcagggtctaatcaaaatcaaaacttaatttatggccgtcaagctttaacttggcgtcaaacgactttccctttttgctcttgaaaccctttagtttgctggtttcccctttggtgaccagtgctttgatcgcggtcttcccgagggtcttactactccatttcttgggtagggtaaagtcttcgccttgcttagacttcacaatgtaaaatttttgtttgtttaatacggttgcttgtggtgtttctaaaaacacctcggcggacttttgtgcttgctgttggtgattgatttgttgcttaatggctgcactgccggttaattgtgtgggaacatcagcgattaacttggtcacaaacttcttaatctggctcaaaaagttatccgggcttagcgttcaaatgaccgctaagtacagaagtggctttagtttatatcaagtaacagttagctcactgaccagtaatttgatcatgttcacccggggtcaatattttggtcatcaccgtaatcaaatacgcttgttcgcgctcaatttcagttcccggcaattccagcattaaccgcgctaggtaaccgaatagctgcgataacaaactttgcagtatcaaatcattcggccaatccacaatcaaatgatctgcttttagttgatttatgacacttcccatctgcttgaccatcttaggcgcaatctggctaagaatctgttcgcgtcgttcggtgtcaaaagctgccatttcaaaaatgacctttaactctttcatgttagctttagcaaatgcaactcggtccgtaaaaattgctgtgacgaatgcctgtagactgggataacgctgccgtaatttatcctctgaaaaatcactcgctaagattggcacaatgtgcgcggtaattggtgctaagatggcatcccgtaaggcaaccttagtcttataccgccgatagaccgtcccctccgcaacgccggcccgttgtgcaatatcactagtactggtctggtcaaaacccttttcagcaaacaaatcgagacttgcctggaggatggcccgttgcttaggtgtaatcgtttcattctgacttagatcctgttgaaaataatcccgtatccgtggtcgttccatatcctcacaccttccgataacgtttcattccaacaatattcaacattgttagtacgaccataaaccctactaatattaacaaattgacaccaatatcgccaagcccagcaccctttgtcacaacagccgtcaacgcattagcaccatagtataacggcatgatgtgggcaattgcttgcaaccaactggccatgccatcgactggaaccaacccagcaaaaaagatttgtggtacaacaatcagtggaataaactgaatcatttgaaattctgagttagtaaaggtggaaataaagatacccaaggtcaaagccactaacgctaataataagttagtcagaaagaccagccaaatactaccaactaagtgaatcttgaagaccacaattgtaaaaacaacggtcagaacagtctgaatgatggcaaagcccccatagccaattagatagcccataataatttcactccgtcgaattggggttgcaagtagccggcttagggttccagtagtgcgttcattcaaaagtgaaacgccagaaatcaagaacacaaagaagaagacaaagaaaccgagaaatgctggcgaaaagttttcaaagaacgttgaatcactactaccataaatataatgagacttagtcgtataactggttgctttagctgactgagtcgaactagacgtcgtggctgtggcctgcttgagttgcttttgtaatttctcagcagttgcctggtcaccgcgggcctgggcttgtgcaatggcagtcttcagcttggtcaccgttgcttgtgtctgggctgctgtcagcttcttcaaagcggcttgttgcgattcaagggccgcgcgctgtttcttagtaacggtcaccagcgtcttcattttcaacttgactaatcctgattgtaaactcgccttaattaaagacgtgttggttggattgctatttgaataagtaatcgtcaattgaccatttttctgagtcaaatagccatctagatcatgctgcttaatcattttccgtgcctgtgaactatcataatgatgaatcgtcacgtttttggtatcgatcacgttaaccacggattggtctacatgatgaacacccaagcttgctacttgcgtcgtgttgttttgaaataagaaatacatcagcgtcataatcagcaatggtgccaaaaacatcagcgccaaggtacgcttatcacgtaacatttgcttaaaaactcgtctaacgattgccatcgttcgcatcttgcatccgccccgctttcaaaaagacctgttcgatcgtatctactgcatactgttgtttcagtgccgcgggtgtcccctcagcaagcgcaatcccgtgccgaatcaacatgagataatcacaccgttctgcttcgtccatgacatgcgttgtcacgagcatcgacttaccggtatccttgagcttatttagttcggtccaaatttgttgccgtaattctggatcaatcccaacggtcggttcatctaaaatcaataattggggatcctgaatcagggcaattgccaacgacaagcgccgtttcatcccacccgaatagccactgacccgcttgtctaattgggacgttaaatcaactaatccggctgcataatcaatcatctgtgctaactttatttttggaacgctcatcaattgcccaaacaaggtcaggttttcacgggccgttagtgtctcatacaaagcgtcactttgagccatataccctacttgtgccattaccgccctattgggcatcaccgtatccatgactttaacagtgccactatccacagcttccatccctaaaatactcttgatcaaggtggtcttcccagctcctgatggcccaatcaagccataaatcattccagccggcagtgtcaaatcaatctgattgagcacttgctgatgaccaaagtgcttgctgacctgcttggcgatgacataatccgttgccattttaataaccctctttctcaaaacgagtgtatactcactcacttaatggccttagtataatcagtacatctcggtttgtcaacattaagatgagttatcactcacttattttgtttccggcctatttgtcaccgcattgcaaacaaaaatgcgccaccccgttgttgggatgtcgcattttaattaaatagcagcactgatataagcgttagcaatgtttaagcctaccgattttttaatattattttattcatcaatttccggcgccgatccaagctctgcctgaatcatccagattttcttctcaattgcggttttgagaccaatgaaaatatcttgggtactgaagtctttttcaacatcggatacttcaatgccgtgttggtaaaggtcttccaagtaacgatagccatcaactaagtgtgcgaggcgttctggggttgttttgtcccattcaccaggccagtcttgaatcttagtgttttcggccatttcttttaaggtcgagtaaggactgccatcaagcgcaatcagccgttcagaaatgacatcgagttggctgtcaatttcttccatgaactcatccatcaaggggtgcaacttcaaaaagttggggccacgcatgtaccaatgcgtctgatggataatcattgacatctggctcaaatcggcaacgagttgatttaatactgctttggttttcgtatatttcattagattgatctcctttcgatatggtgtaatcagatacatagacaaagtcaataatatatttacgttaggaaaaaacaatattagttaaatcgaacaaaatttttgtgattgcatcataagagctatagttattgattaaatttctcttgtggcggataattagacttgaataaagaggtacgactgttttctaaaaaataccgctaatgtgagtgcaataacgagttttatgaaaactaaaatagagttaagggaagattataaaatgaaacagactaaactgacaatcgtggtaccgtgttataacgaggaagaagttttgccaatatccgctgagacattgcgtagcattatgcaacaaatgattgacagtaatcaagttgatggcaatagcaagattctatttgtcaacgacggtagcaaggataaaacttggtctttgattaaggatttagaaagtaaagataacatatttacgggcttgaaatttagtcgtaattttggtcatcaaaatgcactaatggccggaatgaaagttgctggaaggtactcagattgtgtcattactattgatgctgatttacaagatgatgagaacttaatttccaaaatggtggcgagctatcagaaaggaaatgaagttgtactcggtgtacgtaatgatcgttctagtgattcgcattttaagcgttggacggctgaaaccttctatagcgtaatgggaaaaatgggtgtgcaattggtgcctgatcatgcggattttcgtttgcttggtaagcgtgcagtagatgtgttaatgagttacaaggaaaccaatttatttttacgggggattattcctcaattaggatttaatacggatcaactttattatcaaagaaagccaagacttgccggagaaacaaaatatccattaaaaaagatgttatcatttgcctttgatgggattacgtcattttcgattgcaccaattaaagcaattatgtcgttgggtattcttgttattggtataagtctcattatggtgatttattctattatacgtttctttactggaaatgtgattagtggatgggcttcaatcatgacaagcctttggtttttaggcggcattcaattaattggtattagtgtaataggtgaataccttggtaagatctatgctgaagttaaacatcgtccacgctatattattgaaactgatgactatagtgctacgcaacaaacacacgtaaatgatacagtacatgatttggcaggtgtttaatgataaataaagttttagttggatttaattggttagcgggtggtatgcttagcgtggcattcttactggcagccctgatgccaacagagttctttaatcaagaggattgggcaaaacctgttattctacttgttatgctgttcggactactattaattattaacggaattaggcgtgtagttaacgatatctcagatcgaacgtatagatggtgtctatacattgttgtagctcttattgtcattgcacaggcatgggtggcgttacactttattgatgcggcacgtgcagacttgtattttgtccgcaatcaagccattgcattggcacaaggtagccataaatggaattattacttcaaagtatatccaaataacgttaactccgcgttgtttgagggtgctttacttaaagttttacttggatggggcattaagatgccttggactattcttaatttttttcgttttgtctggattgatacgggattgttgtctggactagtaatgttacagcattggaaacatgcacgagcaagcagtctactattcatgctgacttggttattaagtgtgccagtatatacatatggtctatttccatataatgatgccctagttatgccattgattctaaacgtgtcagcattaggttggttgtttataaacaagaacagttgccaaaggtggctggcaggaattggtacttggattctactatccatgggttatgtaatgaaaagcaatctgattgtttttttgattgctgcttttatgaccgcaatttttgcaagtatcagcaaaaaagttgattggaaattagccattggctggttattaggcagtttgataacattgttcttactctctagtttcatgacaaatacggcaaaaagtaaaggctatgttaaaaatactaatttagcgacacctgtaactagttggattgctatgagcttaaatcctgacaagcagggccagtattacggtcgcgatttttattcaatacgtgatactaaaactcaagttgctaagaagaaaaaggctgccgcttcaattaagactcgtgtaaaaaaacttgggaagacagggcttgcttatcatttttatcagaaatttggtgtgttttacagtcatggtgatttcgatgctattaatctaacaagtcagtgggttaaggctccatcatcgtatattcaacgacaaagacattataaattctgggcgttaatgttaacacagagttggtatttagctttattggtgggtagcatttggcaattgttcgcacaacggacgcatttgctaataacatcgatgcttagtttagcaattttaggtttaacagtatttcatgtgcttatttgggaagttgagccgcgatactcactacctttgctaccaataataatgttattaggatgtgaagggtggacaacgataccagctgtgacgctcaatttaaatcgtagaatgattgttagttgggttatggcactaggtataacagttagcatgtttaatattgctcagatgagccaaaaagtaacaatcaaacaaatttcattggctacacaaggtaatggtgcatactttactccaactacattagctattaagaacaactataattttaaagtgcctttacatggcttaaagagtaatcaattagtactccaaacagattctaaaaaccaagttacaattattgtcagaagtaatggaaaagttgtaaaacgtgttgccggtcacgctaatactgttcaacagattaattacccgacctttaacgctaagcgactagatgtcactattacgaatcatgggcggacacctattaaatataatagtggtttagttcactattcagcattcacgggtaaaattacgaagaaaatgcatatgaacatgcgatggggtgttaacagagtttttaatcaaaaagacgctacaaaggttcaacatttgacgcgttataagactattattcaaatgtcatttttctatctatttcttgtacttgtaagtatttggtatcgacctagttcggagctaaatacacgtaaatcgggtttcttaaagtagaacatgtaactatggctactatgtcaagtttacggatataaaaatacgaatactgctccgatgtttttcacttaatctgatctttagagtaaatatcaaataataaaaaattatgttacaattccacttagaagggaagtgtttattatgttagaaaaaagcgcagatttaggagactacggtccagcaccctttgcacctgatttaaaatcggctgctttggaaaatgaaaattatcgaactactttgtggaccggggatcattttcaaatcacattaatggctattccagccggaggtggtgatattggtatggaaattcatcatggtaatgatcaacttatttacttagtagccggtattggccacgttaaaatggggaaagataaagatcatttaacaattgatcaggaaattcatccgggagaggctgtagttgttcctgataacacttggcataacgtgatcaacgctggaaaacagaccatgaaggtcttctctatttattcaccggtcaagcaccaaaaaggaactaatgaagccactaaagccgatgcaattaagcaggagggccctctggagggtactggtgaataagacaaattatttatcaaaagatatgatttatgtcaagaactaatggtattctttgataaataatttgaattagaattttttctgaactatgcaattaataattttttagttgcatttagcaatcgggacttatacaaccgaaagagtggaacatagttccacccttttaatttcaaaatatgtaaagagctgttataaaaatttttagtggaatttttataacagctctttattttttacacaaaataaagtctgtaaatctttctaagacctatttcgatatattcttaaaaataatctacttatctctttaatttttaattattcttagaacgtttagttaagtttgacgcataaattataaatgattataaattatttaaaataaagttcgctttgcctaaaatcatatttacattagcctaaattgtgataaaatttagcatgtattttaaggaggttttataaaatggtaaaagataaatctccaaagaagcaacatttgattcactatgcaaatggtccttctttggaggagattaatggatcaattacagttccaaaagatcaaggcttttggaaaacgttatttatgtattccggacccggtgctttagttgcggtaggctatatggatcctggtaattggtcaacttctattaccggtggccaaaattttcaatatttattaatgtccgtaatcttaatgtcgagtttaattgccatgttacttcaatatatggcggctaaactgggcattgtgtcgcaaatggacttagctcaagctacacgagcacgaacaagtaaaagtttaggaattgttttatggattttaacagaatttgcaatcatggcaactgatattgctgaagttattggggccgcgattgctttatatttgttatttcatattccattagtctatgccgtgtttattactgtgtttgatgttctgttattgctattattaactaaagtcggtttccgcaaaatcgaagcaattgtcgtttgtttaattttagtaattttgtttgtctttgcttacgaagtcgctttatcacacccagattgggctggcgttttcaagggattgattccaactggtgaaacttttgccggttcacctaatattggtggtcaaaatcctttgagtggggccttaggaattattggtgcgacagttatgccccataatctttatctgcattcagctatttctcaaacacgaaaagtcgatcataatgatcaagatgatattgctcgaacagtgagattttctacttgggactctaacattcaactttcattcgcttttgttgttaactcactgttattaatcatgggagtcgctgtgtttaaaaccggtgccgtaaaggatccttctttctttggactctttcaagcattgtctgattcctctgttttaagtaacggtattttaattgccgttgctaaatctggtgctttgtcaattttatttgcagtagcactattagcttctggtcaaaattcaacgatcacgggtactttaactggacaagtcatcatggaggggttcatccacatgaagatgccattatggttgcgtcgattagttacccgtctaatttcagttattcccgtattaatttgtgtagctatgactagtaaagaaacaccaattcaacaacatgaggcactaaataccttaatgaataattcccaagtctttctagcctttgacttaccattttcaatgttgccattattaatgatgactgataataacaaggaaatgggcgatcgttttaaaaatactctgtgggttaaaatattaggatggttctcagttattgctttaactattttgaatatgaagggattaccagataatattatagctttcttcggtgccaatccttctgcaagtcaagtatcattagctcatatgattgcttatctcattattgttggcattgttgccttattaatttggactgttgttgatttatataaaagtcgcaataaaatgcctaaacggtttgaaaccactgcggaacattataatgaaagtgaagatgtgtaatttagaacctaatagattggaaggatattattatgtctaataattctcagcacacaaaattccaacgaattttagtgggtgtagatgattcaccagatgctcagctggcttttcagtatgcaattgctgaagcttatcaagtcaaagcttccttgattatcacttcaattcttgaacacgatgatgataatgtttatcaagctttaaataaagattatgttcatggagaacgtaaagaattagttgaacaccttgaacattatcgtaagttagctttagaagcaggcgtggatcaagtcgatacagtagttgatgaaggcgatcctggagaaattattgttaagaatgttattcctgcggccaaagcagacctattagtaattggttcgttagctaaaaaggggcttaaaaagtattttggctcgcaagcggcttatatggctaaatatgctccgatttctgtcatggtggttcgctagactaatagttggttctcttgcttagctaagcacccttaattattttgggttaagagtgacaattaatgcacgacaaagtgtcactctcccaatcccctaaaagaccccttcaattaagtgttgaaggggtcttttagtatattggaggctctagaacatctgtttgctcctcaactattgttggtgaatttaaacaaaaatcattatttgggttctgaattatcgatttatatttgcttgttttttcgtgtcgttcatgttaaaagttccttaggctagtttattttagtaatatcattaaactgtcattattcacgattactaacttattagaatttttgtcagtgaagagttttcactgagaggaaaaggaaatcactgttttaatccgtttatcaaaacaatgcatacttcaaaatcttctgagaaatatttattcgctagttttgataatctagacttgagatcttttagctctcatatgataagtcagttttggcttaaaccatcactttcaacaccctaccataagccaaacacttaaatattgtgagcaaggtaaaccaatgtaaattgataaatcatttgaattgataagacaaataggccggtggatcatttggattaatgaagcagaaaagctgatgtcaattgaattggtaagacaaataggccggtggatcatttggattaatgaagcagaaaagctgatgtcaatttgagtggaggagacaaataggccggtgaatcatttggattaatgagacagaaaagctgatgtctattgatttgaggagacaaataggccggtgaatcatttggattaatgagacagaaaagctgatgtctattgatttgaggagacaaataaagtgagtgacagcgtcagttgtgatagctttcatttatgacagtcaacacgtgcataatagataaactgctgtaagtgtgtactaatcagagactaagtcgagggcttcgttccgatctccatgtaacagcattacctgagagcatgataacatagctcggcattagatcttcaacactcatcctctcagtgatttcaagagcttcatattcattagaacacagagttgctgacacatgaattaaacatgtaatcaatatacacttgataagcaatatttttgtggcaataatagcagagacgtattgtagcatcagactaacaggagcataatagaatgtatcagcagtgattgagcaatgtgaagcgcacaaatttgcaacaaataacaccttccctaccatgttgcaaaaccgcaaacgatcagtcacagtgacatggatatcggagaaggtagagtgcttgatggtgagcgcgagatgcataaatgtaccacgagcaaagaggaaagaaccagcgggaatgaaattgacacatttcctcgatttaataggctcacaattaactaagctaggataagattcaaggtcagctgcaagcagaagtgtatgaatgtatgatgcccaaatcgcaatgagtgaagaccagaaggtagccatgcggtgaatgagtaatgcaaacttgacacacatggttaaaccgaagaaaaactgagcatgcgccaacacgagatggccagtgacggcagcaaagctgcgaaacataacagacgttggtgagagtatatgagcaacggtgactgacacagcaggggtagtagtcccgggattggcagatggtgacatcacgtggaatccggacccagtcacaatggatatagagtgagaatgcgaggtagcagaaggcactggtgtagaggcaaatggcgtattcgggttaacaagaatacttgagtcaggtaattcagtggtgggggccggttcattgagagtacgtgggccagataatggagtaatagtgacctgttcattgagagtacttgggccagataatggagtaatagtgacctgttcgttgagagtacttgggccagataatggagtaatagtgacctgttcgttgagagtacttgggccagataatggagtaatagtgacctgttcgttgagagtacttgggtcagatggtggagtgatcgtgtaggcatcctcaacctgaggagggaacacaaactcataaagacttccccttttgtatcggccaatcacggtaccatcagtgagagtacattcgacgtcattgaaaataacgtcaaggccactgtgatgagtaatcatgtcaacagagatcaggtttcttgttgattcgggaacgtatgcgacgtttgacaaggtgatagtaatatcatcaggacctgtaaaatcaatggatccgtaaccgacaaccttcatatcgttcatgtggtcaataccacggacggtatcagacgcaggagagaaatttttgaaatgggctctagtatgactgatatggatagtcgcctgggagtcaatcagatagttagtggaccttgttaaggtcctttgatgagtatcagagcaggcaacgtgtggagaagaccttgaaatggtcgacggctgaaaatagtccgggacagacgtggctgaaatccgggagacaggggagggggcaggacatgtaatggagttatgccctctggtccaacatcgcttgcatgtacccttggtggatgcactgaaaggagctgggtgcttcaaagaagagacatcagagaacgccttagagaaacgttgtttgtcctcaaaaaatttgagttcatggtgacgagttgattgcttcaaagtagcagcagaggaggagggattgtattcatcctgagaacactgcttgcggccaacctcgttggatgcatggcgacgtgtcgaagaagtagcaaagacggctgtatggtcatcatttgccggggtagctaaatccctcaaagaaagctcaatggtgcggagcgtcagttgtggactggagacatctaagattctggacgcagcagatggatcggagaatgacttgagatatacgagaccaaagagctgatcgatgcttataccattggcgaattgtgctctgaaagttcgcagaaccttaagagcttgggaaggttgcatagatggaacctggaggaaggtgtcaaccatctgggatagctgacgtgccgtcaacgtggaataatcacgtttgacagcaagaagcaaatcgtaaccaaataggccttcgcattgaaggatgtcaattatctcttgatcaactgtgttgagtagaacgatatgaagaactcggttaagatagcctcttagaagagtgacagttgcctcatctaatgaaccatcaagagggatcaggagatcaccctcttcgaagaactcatagagacccaaacctaaaggaactagaagactttggactgctctaacccatatgtgatagtgttctgcagatcgtaaagtgattacagaccccttgggacacatatgggctattccgctcataacctgttgaagtccaactagtctagtaggtaaatccatattaagtatggttttctgtattaaaggaaaagctacaaaagctctataaagtactagataagatatgtagtggagaggtagtgtagctgcagtgtagctgaggtaaaatattggttctcataaatggaagaggaataggtatgaagtgatgatgacataaccatagaatgcagcttgttgagtgccgtaacaatcacctaaatgaggtaagataccatcgaaatagacattagcataataagtgtaagtacacgtgtagatgaatgcaatgtcaatgaggaattgtacgatttggaaagtggtgacccattgtttccaccaaactctgataccacaagatgagaggaaatagtagaagtacatgagaacatgaacggccaaattgagagagatgacgacccattcaacagaagtgtgaccaacgatttgagtgtaacataacagagcagttgcaccgtgatgataagtatgaaggaagagtaacttctttcttctcaagacgaggaagactgtgtccaataattctaagaatttggtgaggtagttgagatagtaaagagtgactaatctgtttgtgaaagcctctgatgagcaaactgcatgaagaagaccatgatggtaccagatagggaagacttgttcgatcatcaatagtaacaagacgagagagatgagggttaagaataaattatggatttggaagagtaaattgagtttgattggctttgcatctagcttattgagtaaccattggccaccaaagatgatggtatagtatgagatgatgatagagattgcatgtgggaagtttgctaaagctgtcttatatgggatgaattgaaattcatcagctgtgtagcctgccacatattggaatgcctcattaaagattggccaaagatggataccgaaggggtgctctgccgagggcgcggaccaggagatacagtctgtgaaagccattgcgagtgggcgtgtcggagtgcctgagggtgctgctgagggggagtacaataacagcaagaataagaaggggccaaaacaagaatagagacagcggagcacagtgttgcagcagagaagaaaggtgtctcaaacacaacaacagcgaagggagaagtgaaagtgaaaaactggagctgaaagttgagagttgagcgcgggaaaaagaaaattagagaaaaagaaaagaaaagaaaaatcgacgcgcctggttggaaattgtcccgagcgccgagttcccccgaggagagtgtgcacgtgacccgctgctgcgccacacgcgcgctctgctgcgccccacatcacccccacagcacatgcagcacacagcgtctatctgattcgctagcttgatgattaacgcgataaaccggtttcgcgcgcgtattgacaatataattggctttgcccgcgggattggtgcgaatggaacaatagcggtccccgggccggaaggggtctcccgtcgtctcccgcctcttccggctgtgccgatcagccggttctataactagatagctcgatattacagggcgctgtgctagccgcgcgcgatttaatcactcggctgactacttttaagagactgtggctgtagcgagctagagctagctagctataggcgaatacatttaactgcaacggcaacggcaacggcaacggccggttccgactcagggtctgctgaagtaaaagactcggacttgcagtgggcaatgggcgacgtgggtgagggtgagggtgagggtgaggcagctaggggaggctacagccgcaatataaggagcacggatcgctcgtgctggtgctgggtagtggggatagtgattagtgattagtgatggcactcgtagtcgtgtagttgtagttcatcaagacataccgccctcgtcgtgtcgtgtccatgtccacctcagtctccgtctccgtctctctttcacttgcagcagcagatctcgtgcacttccatcatacaccaaccgttaacagaacaagaaacaccgcatttacttctagatcagaagaatcacatttagcatctgctcctgcaacagccacgctaatgaacaaagatcaacttatgaactcttaccttcctccgccgctcgtcatatcgacaagtagtagtaataacaatacaaccagtattggtggtattagcaatggtactggtactactagcattgactctggtaaaggtattagtaaaggtgctcacacagacgaaataccgctctcaaatgctgtcaacctctccactacatcagctgataatatgaatatgaacatgaatatgaacactagtatgaacactagtatgaacactagtatgaacaatagcctcaataatagcatgaacaatagcatgagtacaactatgccaataaacgtgcctatgaatatggtaatgctgccaccattgcagaatcagtctactacgcactcactctctcactcacatccaccatacggttttgctatgcatactaccaattccaattcgaatttaaattcaaattcaaattcaaactctacttcaaatgctaacattttacccaccttcactttccccttcggctcactcaacaataccaacaacatcaataacatcagcagaactaatacacccgtacccgcatcatcttcacagacatcaccttctctccctccattgttcagactctctcacgaccatactctcacacaaccacaatattatcgtcttaactcatatgaatccatggactctaatatcaatggtaatggcaatggtaaacggacgtactcgacagactctcaggtgctctcaccatcagctcaggggaaccattatagactctctctttctaaaccggtactgtcaacgtctacatccacttcatcaatgggatctttctcttctccacatccacgatcgcctctcttgccttcagtttccatgacgacgacgacgacaacaacgccggcaagacgcacttccagacgtagatcatctagagcggcaaattccccatctccaactggttccagtcccacatctagttctgtctctacttccgttccctccacaaaacgtaagaagagagagtgtgagatctgtcataagtacttctccaatctcacgacgcataaggccatccatgatgatggtactaaaccattctcttgcacaacgtgtaagcgttctttcaagagactaaacgaccttcagcgacacgagaagtgtcatctctctcaactaggagattgggaattccaatgtccttactacaacaataaaaacagccatatcgaaggtatcgatgatgatacagaaccttgtcatcacacaggattcttcacacgttgtgataccttcaagaaccacttaaaggcaatccatttcaaataaggtaatatgattagacataatacaagcatgtctcgcgatttgctaaaacacatagaaggcgatgaaacagtcgcaactatatttcctgaaagagagctctttaataaagctactgcaaggcacgcttcaatatttgaattagccaatcatgatgaatccattttaaagcaaaatcaaaagttcatagaacacgccgatcatctttttcaagaattagcaaataaaaccaagtaaggagagttagattatgagtttagattcattcaatcataaaaaagacgaagaaatgagagaaagttacgaaactacattgaaagacaacaagaaagatgcagtcgcatttttgaaaaatatcagccgaaaggaagtagagcgtaagcgatcagttaccttctcaattactgaaagccaactaaaaaaaatggatacggctgcccgaaaaaacggatttaaaaatcgttcagaattcttagcttcaatcatagatgcaatttagtaattaaataaataattaatcaaacaagcaaatgcacaatttatttgtttgattaatttgcgcttaggtaaaagctagtaaagtgcactgaaccaaatacggttgcctgtaagtaagcgctatgctagactaagattaatttgacaaccaaataaagagatcaagctaaacagaaaaatccccgattcacgaggaatcggggattttaggtttaacaagtagctaatagagagctacttagattcagacaatttagaccgccaagttaaaatcgtctgaacattgttcttaatttgtaggttaattataccgcaaaccagtcctatgggacaagtgaaggatagttaaaaacaaattaaatccaatggactaagtagctaaccaatgctatttagtccatttttgttgttagaaattaaaaaagttgccgtataggcaacccgaatagacacatgccggtgaatttacaaagccgatcacgtccaatgttcgctttgtaattcagttaaagcatatcagatttgtattttaaaacaagtcagatgttttagcaactctcttttaagacggcctgtgtcagttaagaaagggagcttttattatggatcaatcaaactttaactttacaaatgctaaaagagcctatgaagtaaagttctacgctttgccgcagatcttactccaaggagaaaaatataaggatcttagcgatagtgccattttactttattcggtgttacgcgatcgtctaagttactcactgagcaataattgggttgacgaaaataacaacgtatatttcatatacacaaacaatgaactaaaagatttacgaaactggtcaaataataaaatcaataagattaaacacgaattaatggacgcaaaacttttgtatcaaaaacatatgggttttaatccaagatcaggcaaaaacgaaccaaatagattatatttggcagatttggaagtaacagcaaaagacgtttatattaagcgagagccaataaaatcgcctaaaccccttggtacaagcggacttctcaaaaagagaaacccgtatgataccgtttctgatacgtctgaatctcttggtacaagcggacttctcaaaaagagacaagatctagactatactaataatatagatactaatagatataatatagatactcaaaagttggacttttccacagcccaattctcaccagcagaactagaaaagcaaaacaaggatttggtgaaccatgctaatgacttcttaactgatgaagacagtgggctccccgttttcttagaacccgaagccgtgcaattacttagcttctggtgccgaactccacaacaaatgcgccggttcattggcattatcttaaatgctaagtaccgagttgagaaggatcatcaggacattggcgttctaatcccactagacgatgaagaactaaaatctttgatgactaaagccttgagacgctactttaacgccctaagaagcaatgaaaagcatatcaagaacgtggaaaactacttgtacggcaccatgcaaaacctatttggcgtttggtggaataaacaagcggctagagaatatgcggccaaacaccccgaagaacagaaaactgacaatgagcgctcttgaaattaaacgtcatatggactcatttaagccattttaagtgttacatgcataattatattaaaactactttaaaatcgcttagaagtaaaaataggtgccttgagtggccaaattgacgatagctgagctagaaaaacgggataggagctttttaaatgaccaaacccagcaaagaaatcgaaacaattgatcaattgttggctgacccctgggcagtcaatattcaagacatttgggaacaagcggcatataatccagatcctgataaacgcaagctgtttgacgcgttacccacttacctcttagataaacgccaagagcaaattatcaacgaaaagcatttcgtgatttaacatggacaggtcaaataatcagtgactgaaatagaaaggaggcacaaaatatggctaaaactcgaacatatatggacaagtataaattcacagctgcagaaaaccaacggtttgcccgagcaaactttaccaagttagtgcatactaatgctcgttttgaaggcgttaataccactttgccacaaacacaaactattatggacggtatgagcgtagcaggagtacctgttgaagatgttttgacgattgttaatttaaagcgtgggtggcaatatatcactgctcaaaattcccctttaacgttaaccatggaaaaacaaatcaacaagattgtggcagcggaagacgccttagtaccgggagaattacggcaagggaaaggaggagttgatttaggtagtgaagacttttttgaaccacctttaattaacgaaaaacaagaacaatcctttttacaaaaaatcttggctgatccacgaacgacgattactgataaagcattgactgtcatgtatcataatatgcgccaacaaatcttttgggacgggaacaaaaggacggcgactttaagtgctaataaaattatgattgacggtggtgcaggcctaatcaatgtgccgttagataagtgggatcaatggaacgaactaattgccaattattatcgaactaatgacatggctaaaattaaacggtggacatatgacaatggcattcaaggattacaaattagagcaaacttagcgtgtagggaagttttttgatggggaataatgaaacgaaactttatgattatttaacgggggcattgatcgtccttattttgctgttgagacgttttttggacacttaccaaagcttcgcaacggtggtattttgttcgctgacgatgtttttactgttggtcggtctattttattatgggatcgtccaaaccgttcacaagacaattttgagccgaccgtggtcactattggcgttgctgggaagcggtgtttacctgtttgttctgctggtgccattaggcctgtttggcttctcaaatttcattaagttttcggtgccgatttctggaaatcagttttcctggctgacagtcaatcgctatccgcttgcgctgacggccattgttggctattttggcctagtgctggttgggatttatttttctcattttgcgttgaacttgcttgctgcggatggcgatcatccaattcaaggtttgaaacagactgttaaattgatgacgttgaaaaagtatggccaaaagctgctcttattattttcaatgctggttggcatctgcctgttgattcttgggctgggctggttgaacagattgcttcccaattccgtcctattctttttgtcacaaggaacgattgatgtggtggctccatttgtcgaaatcgttgtgattggtcgcctgctgggcattcagtttgcccggctgacaggaaaggggctgattactggtgtgggcggatgtctgattatcttctcagcgctgtttgccgggatcaatcccgcgttttccgttcgaccggtcggccatcccacgatcattgttcaccgcggggtcattaatcataacgctcagggaaacacaattactgctttgaagcgtaacagccattatcactttccatttgttgagatggatattcaagaaaccaaagatcatcactttatttgtgcccatgataacgatgtgccaattccaggccacggggatcaggagattaaccgcctcaatctggcagaaattaccagattccatcacgttgatatgttcgctgattatctgcgaactgcgaaccgattaaagcagccgctcatcattgaattgaaggtaactaacagcagtgacccacagatggggactcgatttgcccaacagtttgcctctcaactgacggttttaccacaccgggttcattcggttggttatccatttctccgacaaattaaacaacggattccacaaatcaatgttggtctggtgactatgcttaattttggtaatattggcaagtacaaggtcgatttttacacgctgcagcatctgaccgccaatccattcttgatttcctcggttggcagaaccggtcggccagtctattcctggacagatgatagtcagttatcaatgatgcgaatggaaatgctgggcatcaccgggcaggtcaccgatcaagcgctgcgtcttcaaaaattacgggttaactatcaaagggaccgttggattctacttttgaactcgttgcagaattatttgtgactttttcgtaggtttatagtaggaggtgtagtgatggttaaaagatgcccttgggcaactaccagccctgaactattggtttatcacgatacaatttgggggcgggtacaaaaggatccgcaaaaactattcaaagccctgtgtcttgagacgatgcaggcaggattgtctttttcaacgattttaaaatttgaaccgggaatggatgaagtctttcaccacttttccctggattatttggccaagtgtgaccagtcagatgtcgaacggttttgtcaagatcgtcgaattatccgtaatcatgcaaaggtcagtgcgataattgccaacgccaaagtcattcaaccgaatcctaaaatgttagttgaagcaacctggggaccagttaatggggtttcactggatcatttactaaaagcagcgccagacccaaaaatgtatcaaaaatttaccgaaaagtttgtgaaggcctttaaaaatatgggcctccaacggattggcttaattactgtgtacagctatttgcaagcggttggcgttgtgaatgatcatctgatcacttgtgattttcatgaggaatttcccaccaaaaatgaggaaaaatcttcttgattgtcgattataaatataatatgatactcaggttgtatgttaagcatgttaactatagggagtcgttgtatgacaatggtgattactggggccttgatcaaaaaggcaagaaaagataaggggatgtcccaagttcagctcgctgaagggatttgtacccaagcaaccatcagttccatcgaaaatcaaaatacgtgcagcagtgttgacattctggtcaacctctgccaaaaactggatttaaaaattaccgatgttgccaagaatacgcgatatggtgataaagtcttctcttacattgaagacgatatgcggaatcatttgtatgccgacgctaatagacaaattggtcggattgactgcaaaaagttgaatacccgatatatgttgggcaagtatcattgctatcggggattcattgaattgtatatcaatgatgatattgatgaggccattttcaacttcaatcttcaattgacgcagtattccgctgatgaatttaccttttaccaagcctggtccaatttgggcattggtctggcttatcaaaagctggggaaattggatcgcgccgaagggttcattgattccagtgccaaaattttggctaaagtcaaaaaggccggcaagcacgatatgatcgtgattgttgacctctatgtggacattattgccgcgtacgccgagttgggtaaatatgatcgggcgctgccgctcattcatgaaattttacacgaattgacggagcaggatttgatttataaggtggacgtgctggcggagttggaatcaaaatgcctgtatgccaaaggacaggtcgtccaggccactatgaagcagtttgcagcgatgtttattgcggaacttcgcgggaacacggaattggctgagaaaattcttaagcgcaaccagtcccatattgtcgagatggtcaaaaacgagcttgcaaaaagtgaggggcatccgacctttgttaagtgatggctaggatgttagctgcaaaaaggcagttaaaacaaaaggatttgcgccaatgattttatccatattttttcagagattggggttatcatcttaatgtttatcgccggacttgagagtgatcttacattgcttaaaaaatatttgcgtcctagcataattgtcgcgttgttaggagttttgattccgatggtactgatctatccagttggtattgtttttggcttgacacaatttgaaagcttgtttttgagcgttatttttgccgcaacgtcggtttcaatttcagttgctgtcatgaaagaactaaatttacttgatagtaagagcggttcaacagtcctcggtgccgcggtggttgacgatgtgctagctgtcgttttacttagcattatggtcagtttaataggtacaaaggctggtacggatacccagataccgctagctctgacttttttagagcagctaatttactttgccgcaatttatttcgtgatgcgttttatcgcccctctcctcgctaaactaggcaccaaattattgaatccagtgggacctactataatggcgatgattttgtgttttggtatggcatatattgcagatctgattggactgagtgcagtgattggggccttttttgcaggaattgcgattgcacaaactcatgtagctcatgaagttgatcaaagtatcgaaccaatcggttatgcgattttcattcctgtattcttcgtttcaattggtttaaatatgtcactagctggcatagaacacgatttgttattaattatcgtattgacgattgtggcaacactgacaaaactattaggagcgggaagtggggctaaatgggccggattcagttcgaatgaagcttacctcgttggtgcggggatggtctcgcgtggggaaatggccttgattatcgctcaaataggctaccaatccaaactaatcagtgatgattactattcggcaattatcactgccattatcctaacaacgttattagcaccattactactcaaacatgcggctcgtcatataaactactaaaacatcttagcggtatgacaccccttctctgtgaaaaataactactagatttcatcgagatattgcctagtttaattaagcactaaattatataatattggttataatggaggattagttatttgatacagcttgtaaaagaaaaatttgacgttactcgtttgcgatttgttttactcggcctgcttgtgggtttaatgagtggcaccgttgttagcttatttcgctattgtattgagatagggctgcactatagtcgattggtatatagatacttacgaatcgcgccatttgtttggtgggaatgggcattgttgattggcatcaaccttggtttagctttaattgtggctcgacttctcaagagagaaccttatatctctggttccggaattccacaagttgaaggtcaattggctggcgaattggaaatgcactggtggtcaattctttggcgaaaatttatcggtggtattctggcattgggacctggattatttctcggacgagaaggaccagcgattcaattaagtgcgtcagttggtcaaggtttcgcttctgagtttaagttatcaggaactgatcgccgactactaattgcatcaggcgccgctgctggattagcagcagcgtttaatgcccccattgctggaactctatttgtcttagaagagatttaccataatttttcaccgctggtttggttaacagcattagccggagcaattggttcaaattttatttcgctgaatgttttcggacttgttcccgtgttacatttaagttattcacgtagtttaccagtatcaaattattggcacttaattttactcggcattgttttgggattatttggttacttatatcaacgggtcttgttagttatgcctaggtggtatcatcaattgacacatttgccacgcccaatacaaggtatcgtaccatttctgctggtaattttagttggttacttttcgccaaatttactcggtggtggtaatggcttaattttgggatttggccagcatgttccacctttgtttgtactaattgcaatttttattatacgattcgtcttttcaatgatttcatatggttccggattacctggcggtattttcttgccgattctttctttaggtgctgtgattggtgcggtttatggcgtcttaatgaatcaattaggattattatcgcatgtctatatcatgaacctaatcattttttccatggccggttactttgctggaatcggaaaagctcccttcacagctatcttgctggtaacagaaatggttggcaatttaacacatttaatgccattagcagtcatatcgttaactgcttaccttgttgttgatttattaggcggtgcaccaatctatgaagcattgcttaagcagatgacaatgcctaaaactgttcagcaacttcatcgacctgatcatttggaaataccggttttctttggcagtcccttaaacggcaaaatggtccgagacatgccatggcctaaagaagcactgctcattggaatccggcgtggcgaacaagaagtgattccacatggtgacaccttgattcatgaaggtgatacgttagtactgttaactgatacaacccaacgaccccaagttaaacaacggattgatgcattattagcaaccttagaaaaaaagcaccaagactaagttaataggtaaattggtttatcataatggtaggtatcagattaagtgggtccgttggcagacataaacatattggaaaactatatacaaatacggtgaagtacgaaaaacgctgaaacagaattagttgaacctattttgaaaaatacaaagataaataatatgccgaaaatgccttgctacccaatttttcatagtcatgctataatgtagacagaaaaggaagccttgcgctaacaagacttcctacgcaagccgcttcaagggcggtggcgaagttaataagacagcattaagctaccctgtaacctaccaaagttacgcagggcggcttttttatttgtggtgcttgtcgatatagctgagtagcgcgattaaaaacgtgccaaacagcaacatcaacgagagtgcctggaagacgctcattgactgtgaaaccttcctgaagattattccatgttcccatgggacccgggttcgactcccggtatcggaacattaagcctggttagctcaatcggtagagcgtttgactcttaagtattgttaacaatagcaatcaaaaggctgcgggttcgagccccgcatcgggcttatatttttttattttttgcgtggaggggcaaatttttttatggtgtggtatatggttgtgcttattctgctaccccctaaactttcatttgccaatgctttatctttttcattaactaagcacttctatccatgagtcatgagcatctcgacctacagagacatctggtagcatttctgggttggactcacgcccaaactgttctcctgcgcaatgctcgatgtcgcgggttcgaacccaatctggatactacttgtttgttctgaccgacgcggtggattcgtacttgtaattactgctacgtacaagacgcgttacttgtaggatattgtgggtaggttctttccactatcactgtctcttttggtcaaacgctactgatcattccagtaacagcaatgagtacaggctatcaatttacagacggtaccggctacggccactatatggggggtaacaatctcagttctggaggtcatctcgatggtggcggtggattcgataatagaggcaacaatgattcacaattcggttcaggaagtcaaggaggcaagcctaactatgctaagcagttcatttcacctgttacaatcaagatgttgaatgaggctactctcgaaggaggacacgatggtacttactttacgcatggtgttgaattatcgtacgtgcgattcatcggcgttgttagagatattgatgatcaaaatccaactcataaaatgttgaagcttgaggatggtacagaaatgatgaaattgagggtttggaaaagtgatagtactggtgattatgaggacgcttacgctgatagtgatggaggattcaaagaaccggaatacggtacaggtgattacgtcgaggttgttgcaaccgttaaagaattcaataatcagattcaattccagacacaaagaattgccaagataaagaatttcaaccaagtaccttaccatttcttaaacgttgctaaaaacttcctcgttcataagaatggtggatccctcgctgcaaaaagcgaccaaacaaaggcggaaggtctgtttgtcgctgataatgatgatgctagtggtagtgcaacaacagcagcgaataatgcttccaaaccgcttccagatcgtcttctcgattttatcaagcaacacagtcaaactatgtctgatggtgtgccaatgcaattcatgtctcatgaaatgtcactgactttgaaacaagttgaagaagcaatctctgagcttgtcgaagatggtcgtattttctcaactactgatgaaacgcaattcttaccgctctgatttagtgctatcctactgttctatattttctttatgcgtgttttcacgtgtttttaggcgttttcacatgatttaatacaaaagggaaagaaaaagcctccttcacgtctatatgggagttaaaaagattgccatatgtagtacaatcgtcgaaggagttcaataaacctgtattggatacccaattaagtgggtagatacctgacagtcaggtaggattctagagacgatcaggtatcaggtaaatttacctgtcaggtctgggataactgatcgcgaaaattacctgacagttacctaatcgggtaagtgtcaggtaaatctatacctgacagatacctgatcctaaatggaatgcgcggagataggcgcgccacaacgagacggccgagtctgctcgagtttggcagtagccatggctgtagccacctttttgtatgggctgtagcgattctgtaaccactcgcgaagcctctattagccacccgatttgtacctttgcaggatgcgcgctgttagtgcttctaacgctccttactccttacagtggccatggctttagctctaaaactagaagctataatcatacttttgaaacaagcactgacgtggagtccatgaacgtatatataatcaaataatagccaagcatcttaggtgcacaatttacactctctagtagggtatcgagtatcatgtcctcctttttggattggtgaccgtctcttgtgcttcgacaatggagcattgtaatcaagctgactggtacctgatatcttatgcctgatacttacctgacagatacccgatctacatgaaaactaccagatactagattttaggttgcgatcagttatcccagttctaatgtaaagttataggtgcaagacgagagggagaatagtgattagagacgcaggcatgaaagtctacggaagaagaaaagacgtaagatgggttagctagtagcagagatagatatgatttaataaatatagtatagagtttaggtgttgtatatataaattgaagatagcgtccgagtccgagtccgagtcctagtccgaatccgttgttcgtgttgaattgtttagcaaaatgtgacaagcaccgtatgtatggacgtgcttgcaccgttaggagaggaaaaatcagttgagaagaaagaagggttgggaggactttgtagtgtgttgaaaaagataaaaaccgtgtgttgtgttgcgtgtgtagtaggcagaaagacagacttgctgctgtgtatggacgaaagcctagctttcggaagctgtcccttgcttagttcattcattgcatcttgaatctgaggtctaagagctggtcagaccacatgtcatcggataactcaaaggagttgatgaacgagttagggtcttgcgctgcagagctggaatcgaatagcgatgatgggttgtatgttgttgcgtacgattgttgcgctggcgcagatgctggtgcagcctgtgcagttgcatgagaagaaatggagattgggttgacgttggagtggttgacatcatgagagaacatttgcgtggagccaacgaactcgttgttgtacgcgtcgttgttgaagttcatgttcatgttcatgttgctcatgttcatgttcatgttcatgttcatgtcgtgatcatcaaagcggaagacatcattctcattggaattgtcatccagctttgcgtcgttgaaggaggcaataatggagttggatttgacaattgaggaactaaaactttagaaaaagatacactagttatgattttaagcgaacaagctcctggattattaggaatgacagctaaaataccagaaaacaataggtatgttctcaatcaacgtgttgcagaaataaaaccaaatacaaatatagacagctattttttatctatgtctataaatagatcacaagcatattttagcaaaagaggagccggaactaaggttcaaaatatttcaaaaccaaacgttgaaaattttgaattctattgtccttctgaaagagagcaacaaaaaatcggttcattcttcaaacatttagatgacactatcgctcttcatcagcgtaagttaactaagcttaaggaacttaaacagggctatttgcagaaattgttccccaaaaatggcagcaagttcccgcaattaagattttcagggtttgctgacgcttgggaagagcgtaagttgggtgatatagctcccttacgtggcggttttgcattcaaaagctctaaattcaggaacactggtgtgccaattgttagaatttcaaatattctttccagcggggaggtaggtggagattttgcatattatgatgaacaggataaggatgacaaatatattcttccagataaatcagcagtcctagccatgtcaggtgcaacaacaggtaaggtatctatactatctcaaactgattatgacaaggtctatcaaaaccagcgagttggttattttcagtctgtagactatattgactacgggtttatttccacaatcgtccgttcagaattattcatgatgcaacttgagtctgttctagtttcaggcgctcagccaaatgtatcgtcaaaagaaattgattcgtttaattttatgattcccatattagttcaggagcaacaaaaaatcggttcattcttcaaacaactagatgagactatcgctcttcatcagcgtaagcttgaaaaactccaagaacttaaaaaggggtatctacaaaagatgttttgctgattcttaatttgatcaaatttaggatcctatgaaaccccatgacttaatttttattgtgcttggtcaacacttaattcacctgtataatggattacgcaggaagttttaagggcggtggctgtcttttcccttgcgaggtgaggcccatgggaacatggaataatcttcaggaaggtttcacagtcaatgagcgtcttccagacactctcgttgatgttgctgtttgcaatgtttattttagcgttgctaacatacatcgaccaaaggaacaaataaaaaagccgccctgcgtaactttggctaggttacagggtgactcaactatcatttcttaactaatgccaccgcctttgaagcggcttgcatgggaagtcttgttagcgcaaggcttcccttttctattacattatagcatgacctttaaaaactggctaacgtttcatgcttcgatcagattcaggatcaggttgtttgatttccggattctgttcagcaaatgcttgcagctgtttttgagtttgcttactgattttctggtgtacatcatttaatttattttttagttctgatttttgttgtggattcgttgcttgctgaacttgttgttgcaagccttgataggacttattaagatcatgagctgatagcctttttagatcatgcgcaggctcttttggggcttcttgtaagcctaattgtttggttaacccgtcgctaagctcaatcactttgttggtcacttgctggatctcacttaaagcactatggatcacggctttatctttagcccaggtagctacataaccgagggagtaattgcccgtaccaatcccaatattttgcatggcgacatatgcgaccgcttcggcttgggtttcctgataggctcgtgacctatctttaaaggctgattttaatccgtgtagctggctatgcgcatattcgtgatataaagtctttagtttcaaagcattgtcgggctcatcgctaccaatgacgatttcattagtgctgggttgaaaataccccttaaccccatttagcgtcgctaaaggcacttcactgactttaaggtcgggttgctggtttaaataatctttgaacgcgttatacaagctcgttacattctgatgatcagccaaattttctttgacaaagtctttagcacttaacactgcttcaccgctagtttgtgacacatcaaagacgggtagataacgataaccgacaatggcgcgctcatcggtggtatcaagatgcttctgctcggctggtgttagcttcttaatgatcggagccgcaatccgaatcgcttttgcgccccggttgacggtgcggttaaaagccttctgccattgcttaaaacccgcgacttgagtggcttgaggattttgcgcataaattaaatcaatgtttctggcgctataacgatgaaatttagccagggtattgagatactttttaaattggtcactatcagttaattttaggatttgctgttcagcctgggcgactaattgtgctttccaggctttaacgtctgctttactcggcattgtctacccctcctcatcttcaaaaatatcattcagtatgggagccacttttgtttgaattgaggtcgtgccataaagggcaacgtaaccgtcagacaatttttgccaagccacttgataataggctccgttaccagtgatttcttttaaatacttgtaggttcctttagcctgcaaaactggtaattcactcccaatgactgctaatttattatccattttatgatctcctttgctttgctaatctcacccgttgtttaggtttacttttggctttataaaagtgaacctaaacaacgggttcaacaacgtgcagggcggtaggcaggctctaatcaaaataaaacttaatttatgaccgtcaagttttagcttggcgtcaaacgacttaccttttttgctcttgaacccctttagtttgctggtttcccccttggtgaccaacgctttaattgcggtcttaccgagggtcttactgctccatttcttgggcagggtaaagtcttcgccttgcttaggcgtttcatctaagctgtcgaaatagccaatatagcggtggattattttttataaccaaagttaggaatcttcgtccaacggtctttcaggtaacggacaaccatcttcggttcccgtgatctggtgaagattcctttcttattaccctgaacccgttgaatgccaaatttggtctggaagtcggcgaagttccacaattgttcaccgacaaagtgtgggaattcatcgaagaccttgctggccattcgatagtagtcttcctggaattcttcggagaatggctcgtcataattgctgtgcagccccggaatggtgtcagcaccgtattcagtatacataatgggtttatccgggaatttgtcagaatattcctgcagctcatcgcgggttgcttgttcagccgtctttaaatcaccattaccaacataccaaccatagtagcggttcaaagcaatcacatcaaccaatccgatacagttatctgtcttcggagtggccatcatgatgctggtataagtgtagggccgcttttgcggatccagttgacgggcttcatcaaataacggcttgaagtattcatatgccccttttgaaaaggttgctgcttcattggcaatcgaccacattgcgacacatgcatgattcttgtcacggtcgatgatttctttgatcacctgtttgtgggcgtcggcggtctttaatttggtccaagtatcgtcttgatagtcgtcgctctcaagcattgacacatcaaacccgaaggtcaccatcaacccgacagctggcgtttcatcaatcactacaattccttcgcgatcacataaccgcatcatttcctcggagtatggatagtgggaggttctaaatgaattagcgcccatatccttcatcaaattaatatccaagacattaaccggttggttgattccccgaccatgaacgtatgaatcttcatgcttgccaaagcctttaaaataaaatggttcgccgttaattaagaactgggcgtttttaacttcaatcttgcgaacaccaaagtcctctgaataggtatcgatcacttcaccatttcggctgaccgtcacttttgcggtatagagataggcgttcaatggctgccaaagatgaacgtggtcaatatgcaacgtagtatcggcagaagtgccgattactaccggctggccatcttggtccaaaatggtcactttaaccgcatcaatctccccatgggtagcgactttgacctcgacgtcagcactggattcagccagatggacgtctggaacgaccgtgatatcgctgatatagtcagctggcgtcgagtagattttaactggtcgttgaagaccggcatagttaaagaaatcaaagttttcgtcatcgtggcggagcttgtggccatcttggtcagtgctttccgaatagttgccaaccggcagagtcgtgtaatcaagaatattgctgagtttaacggttaagcggttgtcgctgtcttttagataatcgttaatttccacctcaaacggtgtaaagccacccttatgatgggtaatttcctggccgttgaggtaaacccaagcttcatgagtggcggagccgaatcgcaagactaaccgctggctgcgcaatggtttggcaatatcaaaattagtttcgtaccacacaaagccgttgtgctcacgaatcttctttgacgcggtttgatcattgaaggaagccggaaccgaaatgacgtcttcagttggcaacggctgtttgggatcgattggcgtgatctcctcatcgatcataaatttccaaagtcctgataagtccagaaccgttctgctgggtgttgtgagtgggtataacatagttaaaatcctccgttcgtcagtcagtatttgggtcactgcttttcaatgtctttaatataggctaaactgggatcgaatacttatctaatttttacttaaatcgcattttattgacttttatgtaaccgctaccagaaaggagcttgacgatgaccgcgtatgacaaccaatcaactgctgaactgattcattccctgacccaaattgatattgccatcattcaaaaagacggcacccccgtggtgcaaattcaagagaacgtgttacccgccttccaccggctcaacgagtttgatccgatctttcaacaaattgagcaattccatgctaatgagtacctgacttacacggattccgcccagctgagctacgtgacggcccgccttgaccaacctgacgaccaagttgtcgtcttgggaccgttcctaaccaccaccctgaccattgacgaaatcaatgacatcgtggcgatgaattcctataccatcagcgaacatcggcaactcacccagttgtaccaaacttcctaaaaaagccgccctgcgtaactttggccagttacagggtagcttaatgctgtcttattaacttcgccaccgcctttgaagcggcttgcatgagaagtcctgttctagcggggcttccctttttctgtctacattatagcatgactataatggactttcgactatttttaatcaactttctgccagtttttagggaacacacgtttgccttctgtgctacaatacaggtaaaagctaacggaagtgatgaatttgtttactgatgatgaaccgcatggcgtgttcttcttaattgataacaagtccttttatgctagttgcgaagccgtttcccgggggctaaatcccttaaaagtcccattagtggtccttagtgaagctgaaaacaccaatggcggactcattttagccacgtcacccgaagctaagcacttatttcatcttaaagccaacgtctcccgtaaacgtgacttacccaatgaccccaggttgtgggtcgtgccaccgcgcatgaacctttatattcaacgtaatttgcagatcaatcagatctttcatcaatttactgcccatcacaaaaaagttattgacgggaacaccaacgatttcagaacgggattttttggactggtgtcaggcacgactggcgcaatggtctaggagtttaggcggttaaattcacaaagtgagtttactgattttttggggatttttcatctagaccactcctctcccgtcaaatttcacaaaggccaaataatggatcgttgttttatcagggagtgagggggttacttgggatgagccgcattatgttaactagcttaaaattgcacaataaaaaggcctacccaattgaggatagacctttttactttattcagctttgtcatctactttaatctcagcactagttgaggtcacattagaaacgttcgcactagttggtgctttatcagcttggctagcggagtccacctcgtttgtaacatgttctaaggtgcctgtcgtgtcctgtgagacgtttatagtttgtacgtctgtaattacacctagcatacctaaaatggtcagaaccgtgttaatgggagattgcaaatttgtccaaaaattcggattaaatttgcaatctcccagaaattaaaaaagttgccgaatgggcaaccaagaatagacacatgctggtaaattacaaagccctcacggctaaatgaatgctttgtaatttagttaaagcatatcagatttgtattttaaagcaaatctaatgttttagcaactctctttcgagacagtatgtgtcagttgagaagggaagttttataatgaatcaaactaatttcaattttattgagtcggaaaaagcttatgcaactcgttttttccaattcccacaggttttaatttatggatctcaatataagacattaagtgatagtgcaaaattaggatatatgattttacacgatagactagattattcattgaaaaacaactgggttgatgaagataaccgggtttatttcatttttacaaatcaagaactaacaaatcttatgggctggtcaaaaaagaaagtgattagagtaaaaaatgaacttgaaaaccaaggattattatttcagaaaaccatgcactttaatcccaaaactggtaaaaatgaaccaaatagattgtatttagcagatttagaagttacggcaacagacatttatacaaaatctcggcaacaagagccacgaacccttggtacacgcgaaagtgtcaaaacggaaccttcgcggaagttcgttaaaacccttaatacacgcgaaagtgtcaaaacggaaccttcgcggaagttcgttaaagttacaccacaaacccttgatacacgcgaaagtgtcaaaaagagtcacaatctagactatactaataatttagatactaatagatataatatagatactcaaaagttggacttttccacagcccaattctcaccagcagaactagaaaagcaaaaccatgatctcataaatcatgctaatgacttcttaactgatgaagacagtgggttaccagttttcttagaaccagaagccgtgcaattactaagtttctggtgccgcactccgcaacaaatgcgccggtttattggcatcatcctgaatgctaaatatcgagttgaaaaggatcatcaagatattggggttctaatcccactggacgatgaagaacttaaacctttgatgactaaagccttgagacgctactttaacgccctgagaagcaatgagaagcacatcaagaacgtggaaaactacttgtacggcaccatgcaaaacctatttggcgtttggtggaataaacaagcggctagagaatatgcggccaaacaccccgaagaacagaacactgacaatgggccttcttggaattaaacgtcatataggctcatttaagccgttttaagtgttgcagtgcataattatattaaaactgctttaaaatcgcttagaagcgaaaataggcaccttgagtggctgaattggcgatgactgaactaagggaatttgaaaggagctttttaaatgaccaaatccagcaaagaagtcgaaacaattgatcaattgttggctgacccatgggcagtcaatattcaaggcatttgggaacaagcggcacataatccagatcctgataaacgcaagctgtttgacgcgttacacacttacctcttagataaacgccaagagcaaattatcaacgaaaatcagtttgtgatttaacatgagtgagctaaagagatacctcatcgtggctgggataaacggcgctggtaaaagcactttatatcgcgcgagacccgaattatttactcactccaaacgattaaatgccgatgaaatcctacaaaaaatgggtggcgattggtataaagatcgtgataactttagggcaatgcgcgaagaaataaaacaactccacgcggctttagataccgggcagagtattcatgttgaaacaaccttggctgggcaaggaaaggcacaattaaatttaatcgagcgggctcaccaaaatggttttgaagtaacacttttatatgtggctttaaaaaacgaaaaagtcacaattaatcgggttcatgagcgggtcaaaaagggtgggcacggtgtaccagatgaagatgttaaatttaaaaattagaaatcccgttaatgattcagaaaataaaaacgatcggcctagttattaggctgatcgtctttaaatttattcggtttatgggcattaacgtaattggcaaatatttttaaaagttcttcggtttgttcgaccgataggttatcagcttgaaagtatttttctagcaaagcccctttttgaattaatcggcgagaacgggctttgcgggtttgccgattttcgtagtatttagattgccgtaatttaaaatcttctcgctcaattttttgttttaaacgcgcttgttgctcaactagtttttcatattgattagaccaatatctgatacaatggacaccatctactctgcctctactgcaatggacaccatcttctcttcatgagacactatcctgttgatacagtagtcaccaactactactgaaatagaaactgtatcttcttctactacaatggacaccatatcaccgtctttaaagacgctactctcctgatacaaagacacttctcttctgatacaaagacactactctcttgatataagaacaccttcacttcttcttctaggacacattctcatcttctaagacactactcttcttctgctacaaagacacctctcttcttttaggacactactctttttctaagacacttctcatcttccgcttcttcctgtatcgaagacactactcttcttctgatacaaagacacttctcatcttctactattaagacaccttcacttcttttactttaaacacaccttcttcttctgatacaaagacacttctcttcttctactattaagacaccttcacttcttttactttaaacacaccttcttcttctgatacaaagacacttctcttcttctaagacactactcttcttctaagacactactcttcttctaagacactactcttcttctactattaagacaccttcacttcttcttctaggacaccttctcttcttcttctgatacaaagacacttctcttattctaagacactactcttcttctaagacactacacttcttctaagacactactcttcttctaagacacttctctacttctaagacactacacttcttctaagacactactcttcttctaagacactactcttcttctaagacactactcttcttctaagacacttctctacttctaagacacttctctacttctaagacacctcactacttcttcttctactataatgacaccttctcttcttttactataatcacaccttctcttcttcttctactattaagacaccttctcttcttcttctgatacaaagacacttctcttcttcttctactattaagacaccttctcttcttcttctgatacaaagagacttctcttcttctactattatgacaccttctcttcttctcctaggacaccttctcttcttctaagactactcttcttctaagacgcctcctcttctccttgaaaaaatactctccgggtactatgcacaccgtctcgtcttcaggaacactactctactgaactactcacacctctctttctccgccattacagttcacaccacgttccaacgcagcataccacaagacatacttgcatacaagcccactgttgcttctgctgcccctctctggccgtgtggcgactgtgcccgctgctgctgcccggactgacgccaaaagccactatgaaacgcgtcgctcgcctcagcgcgcctgggccgccgacacttttcggtgctgctcgcggcctgctgctgctggtgccaccaaacgctggtcaacgactgtagaccactgcttgataccaactagtcttccatcggggcccttggcccctctgggcgtgcctcaaatcattatgtaaatccccatagttaaggatattgatatgcatccactatagaagattgatattccgaggcgatattacattcgctaacaaaactgacccgcgcctcgcgtcatatcgatcgatataccatactaatttttcaaggccatattctgagtccagtaccaatggctctgacatcggagacataaagttgatcgccacaaccactgccatacaaaacagcgatatttcaacctagcgtatctcagaaacctcttcacatatacgcaacatgagactaccaaacacaatagatgcacttgctgtcatggcctcatgttagttggttgccgatatcactcctggtagtcacttacggtcacttttagttttggctgttgccaacttggcatggcattatctcgacaatggctgggccaaactccaaacaaacttcagatacatcaccgctgcgataaggagacaaggtctggtgccagatagaagttcaaacattccctacttactgcacatcatggtgcacaatggcgttttcctggaactgaccatgggagacgaaacagtcgcagacattaaatatcacggaggaccattaatcttccgagactctacgaacgtgtatacatcatctataaaatcacctactatttctgcttttctgcaaggaagtagtgacgagagtggccttctcttatccctagtcttacaaacagagtacagtatttctaactgaacgttagccttaacattcatcgctcgaaataataaacgttaacacaaaccaagagattcgcataacgaagttaacacgaggttaacaggtcgacattgaagtcaacggaatggaggtcaacgcaaagtcaacggaaagtcaacaggaggtcaacaaagtcaacaggaggtcaacaaagtcaacgggaggtcaacaaagtcaacatgaagatcaacaggtcgacacgaagtcaacgagggataatgggaggtcaacatgaggtcaacaaagtcaacatgaagatcaacgaagtgatgatgaagccagcataacacaaggtcagcataacgtcacttcttcatcaagaacaagaatcataaacacaataatagacttgatgaacggttagtataatgcccgtggaaacataagagtgtatcagttgaaacatacctgtgatgtggttccaagatgttatcagttgatggtattagacagagtgttcaagaatcctcaatctcagtttggcaatggcacttgtgcctaaggcagggggcagaacccactgactcacacacgtggcttgaagaacgccaaagcttcgccgaagctaactcattcacttaaccttccagcaccgggcaggcgtcagcccctatacgtcatcttacgattttgcagaaacctgtgtttttgataaacagtcgcctgggcctattcactgcggctgatctttcgatcagcaccccttctcccgaagttacggggtcattttgccgagttccttaacgagagttctctcgctcacctgaggatactctcctcgactacctgtgtcggtttgcggtacgggtagttaaactctaactagaagcttttctcggcagtgtgacatcaggaacttcgttactttaaatttcactccccatcacagcttgtccttaaagttgaaagcatttaactctcaacaagactcgctgcttgggcgcacatatccaaccgtgcgcattccttagcctcctgcgtccctccattgttcaaacaagtttaactagtacaggaatctcaacctgttatccatcgtctacgcctctcggcctcgacttaggtcccgactaaccctgggtggacgagccttccccaggaaaccttagtcattcggtggacaggattctcacctgtctttcgctactcataccggcattctcacttctaagcgctccaacagtcctcacggtctgccttcattgcccttagaacgctctcctatcacgtcaccttgcggtggcatccacagtctcggtaatatgtttaagccccggtacattttcggcgcagaatcactcgactagtgagctattacgcactctttaaatgatggctgcttctgagccaacatcctagttgtctatgcaactccacatccttttccacttaacatatatttagggaccttaactggtggtctgggctgttcccctttcgacgatggatcttatcactcaccgtctgactcccggacataaatcaatggcattcggagtttatctgaattcagtaacccaagacgggcccctagtccaaacagtggctctacctccatgatccttaatccgaggctagccctaaagctatttcggagagaaccagctatctccaagttcgtttggaatttcaccgctacccacacctcatctcagcacttttcaacgtacacgagttcggtcctccagtgcgttttaccgcaccttcaacctggacatgggtaggtcacttggtttcgggtctacatctacatactcagtcgccctattcagactcgctttcgctgcggctccgtttcttcaacttaacctggcatgtaaacgtaactcgccggttcattctacaaaaggcacgccatcaccccttaacgggctctgacttcttgtaggcacatggtttcaagaactgtttcactccccttccggggtgcttttcacctttccctcacggtactggttcactatcggtcactagggagtatttagccttgggagatggtcctcccggattccgacggagttacacgtgttccgccgtactcaggatcctgaactgagggatcttcattttgcctacggggctatcacccgctctggccagtcttcccagactgttcggctatgaaaatctttggtaactcaaatgttcagtcctacaaccccaggaagcaagcttcctggtttgggctgttccccgttcgctcgccgctacttagggaatcgatatttctttctcttcctgcgggtactgagatgtttcagttccccgcgtctacctccagccacgctatgaattcacgtagtggtaacaacggattagtgttgttgggtttccccattcggaaatctccggatcaaagcttacttacagctccccgaagcatatcggtgttagtcccgtccttcatcggctcctagtaccaaggcattcaccatgcgccctttataacttaacctaactttaccaaaggtaaagtggttttgagtttagcgattatttttcgaactaatcttgttttaaaactctataaaacgcggtgttctcggtttaattacattataataaataattaaaattagaaaatttttcgatattatttagttttcaaagaacaaattttgagagtaaacctctcaaaactaaacaaagtttcgacaatgtgtaggtttccgtttctaaatatccttagaaaggaggtgatccagccgcaggttctcctacggctaccttgttacgacttcaccccaatcatctgtcccaccttagacggctagctcccgaaggttactccaccggctttgggtgttacaaactctcatggtgtgacgggcggtgtgtacaaggcccgggaacgtattcaccgcggcatgctgatccgcgattactagcgattccaacttcgtgcaggcgagttgcagcctgcagtccgaactgagaacggttttaagagattagctaaacctcgcggtctcgcaactcgttgtaccgtccattgtagcacgtgtgtagcccaggtcataaggggcatgatgatttgacgtcgtccccaccttcctccggtttgtcaccggcagtctcactagagtgcccaacttaatgctggcaactaataataagggttgcgctcgttgcgggacttaacccaacatctcacgacacgagctgacgacaaccatgcaccacctgtcattctgtccccgaagggaacgtctaatctcttagattggcagaagatgtcaagacctggtaaggttcttcgcgtagcttcgaattaaaccacatgctccaccgcttgtgcgggcccccgtcaattcttttgagtttcaaccttgcggtcgtactccccaggcggaatgcttaatgcgttagctgcagcactgaagggcggaaaccctccaacacttagcatgtaagaggaagcccgccgaaagtaaaaagctaacaacagctgccttaaaaagattaataaatatagctgttttattgcaaattatctttaaatgaagcatcaaataaacgagcatcccaaaaccacacaaggcagttgtaatcaaatgcgtatacaccaataacgtcatagcaatggtcaacacaaaccaaccatgatttttagcataaactaagttgtagatacctaaaacaaccatcggaagaaatgccattgcaattccttctcctaaagcatttcttaccagcatttcatattgataaaaaattgaagtcatatacaagatcgcaacaaaaaaagaaattagttttttctttgaaatccttaaagcacagaaatatgtgattactaaacccgaaaaattatatatcaataatagtaatttgtaataagttaaataggaaaaaggcattttagaaaacaatatcaaaggataaaaaattaaattactgtaaaaaagtggagaagaatatccgttaccatttagaaagcccactgctattcttggaaaatattgatcattatgaattgacattaaaaaacttctcaaacgattcatatgaaagaagaaatctgtactgataacaaccggatattttttagtgctccataaagaataagaaaaaagtaaagtaattagtataaagataaaaaatatagccatagttatccaaatactttttctagatttgagttgcatttttttaacatgaggtaatatgatcctttcaatacttaatcagccgtcctacagattttagaattgcaaacactaaaacaacaattgcaccaacaacagaaatgcttatagcaattttttgccaagttgttggaacatagtttatttggatttctctatcatttttgaagatcttcacattagctaacttatatttactgagacgtaatggcaccacgtgatgatcaattttgacaacataattttttttatcgtaaatataaaacggcaaagaaattctatagtttccagaactttcacttattttatacttcataccattaggaatactaataacccttttgaacttgatagtatgtccattttgcaaaattcccctatgattaataactcgatgaaaaatttcaatatcagcgggtctagcaattttatcatctagtggaatgtagtcactagtattatttaatttggttaatcgataataatttgaattatttacttttatttggtgtgcgtgtgcggaactatctgtggactttaaagtaaagtttaccacaggcaacgtctgccgctggtcaataaactgatcaactgcacttaaattaagcagcagcaaaaatataggtagtagccaaatgaaaattttattttttttcagtttaaatattggagtaatcacatcaactccaagaagagatataaaaaagttagcgataatcaaaaaacgccatggaaactggataattgcaaatggagtagtttgcagtaaaaaccagggaaataaatttgtagaaatgaacaaactgaccagtgtccaaataacaacttgcttatgatggtttataactatattttttttaaacaatattaatagtaaaattattattgcaacgaaaccaacattatacgtttgaccaccgaatcctgatatactatttgataatgaactttcaaaaaggttacccggatttatagccgattgttgtaaattggttacagcaggtgttttaatcgaattaccgtgaaaggtatataaaaggttatatatgaatccaaaagctagaatgaaaaacaagccaaccgcaagaaacaggcattttaaggattttagaatgtttttaatctttttaaaattaagaattaaaataataaaaaagaaaaaagtaacaattactaaactcaaaagatgggaatataaaatcaaactcattccgattgcaagaattggccattcttttacatctgcaaaaaaaacttcgtaaaacccaagaaaggctaagggaacgaatgcaattgctaaaagttctccgagatcaaaacgtgtaagcatatcaataaaacgataagttgaaaaaaaataaaaattcgtaaagataaacgctttaaaagttgacccagaaaacttcatataagaataatgagcaaccagacaagtcattaaatttagaatcatcaatccatcatatattgccgaaacaggatttttaatcaccagacgtaaaaccgcaaatggataaataaataaatttggatagaactggtccatagcaattcctacattattataagaatatgtagtgataaatgaaaataaagagtgatgttttaaaagatgcgcaaggttttcaattctgtcaatgtgaaaatgcaaatcatcgcccctaaaaatataaccagttttccttaaaaaaaatagtgaaaatatactgataaatatataaaatgacaatatcccaaaaagttttacgtttttcttccaatcaaagtcaatgcttattttcttgcttttcatctttcattcccccaagtgatcgcttctttgatcagtttatcatacacgaatgttaattgaaataacgtcacgtgagagttaacactcaaaaatccgtgttggactgaacattcaataataacgttttctaaaatattatagtgtgaaaataattaaccggtcacttgatttacaagtgtggtggtatcgacaagagaactattgaaaagtttgagaaggaagctgctgaactcggtaagggttctttcaagtacgcttgggtcttggacaagcttaaggctgaaagagaaagaggtatcaccattgatatcgctttatggaagttcgaaactccaaagtaccacgttaccgtcattgacgctccaggtcacagagatttcatcaagaacatgattactggtacctctcaagcagattgtgctattttgattattgctggtggtgtcggtgaattcgaagctggtatctccaaggatggtcaaaccagagaacacgctcttcttgctttcactcttggtgttagacaattgattgttgctatcaacaagatggactctgttaagtgggatgaatccagattcgatgaaatctgtaaggaaaccgctaacttcatcaagaaggttggttacaacccaaagactgttccattcgtcccaatctctggttggaacggtgataacatgattgaaccatctactaactgtccatggtacaagggatggactaaggaaaccaaggcttccggtgtcgtcaagggtaagacccttcttgaagcaattgatgctattgagccacctgtcagaccaactgacaaggctttgagattgccattacaagatgtctacaagattggtggtattggtactgtgccagtcggtagagttgaaaccggtatcatcaagccaggtatgattgtcgttttcgctccaaccggtgttactactgaagttaagtccgttgaaatgcaccatgaacaattagaagaaggtgtcccaggtgacaatgttggtttcaacgtcaagaacgtctctgttaaggatattaagagaggtaacgtctgtggtgactccaagaacgacccaccaatgggttgtgcttccttcaatgctcaagtcattgttcttaaccacccaggtcaaatttctgctggttactcaccagttcttgactgtcacactgcccacattgcatgtaagttcgatgaattactcgaaaagattgacagaagaaccggtaaggctactgaagaccatccaaagtctgtcaagtctggtgatgctgctatcgtcaagatggtcccaaccaagccaatgtgtgttgaagctttcactgactacccaccattaggtagattcgctgtcagagacatgagacaaactgtcgctgtcggtgttatcaagtccgtcgaaaaggttgacaaggcaggtaaggttaccaagtctgctgctaaggctgcaaagaaataagtcccttgactgatgctagtttactgtcgtctgtatagtcttatttccttaaagtattttccttattaacactctagtgcgctgtatacgtagaattgaaaaagtatcaatcgtctattgtctattccgtcggaaactagacgtggtcagggtcaaaaatttaataagctccggtcaaatccgcgataagctacttattttccagcaatttcaggcggtggccggattctgattgccatatttaagccagctagttgcgcctggccgattagagtttgactgcacctccaccgttttccttttcagtatcggctgattattcttttagttaaaggctgaaccttttaataagcttttattataaaagcccggcacatcgtcagatactgaacaactgcatatagtaagtctcctcaagcacatcaaaatggccacagttgcaacaaataccactaaacaccaaaaaatggatcaaacaaagcttgagatcatcgaccttgaagatacctcttccgataacgctaagaaaattgtgcatgcatcatccacgcaagggttcttaatgtttgaaggacatggattcacagacaaagaaattgatctattatttcaatattcgcacggttatttcaagttacccgttgatgagaagaaaaaatgcgtcattcagactgataatgcaggttatacaggtatgggtgtcgagaatttggaggaggatgatttagatagagggtatggtgatccaaaggaaggattcaattttgccaattttgatttgaagacgggtatccctaaacaaccaattcctgaattttggcaagataagatggaagttatcagtgctacagttttgaaacttcgtgatgctttgaagaaagcactcagattaatggccgttggattggagattgagggtgatgaaggtctcgatgaagattggttcgttcaaagacatcacgatgatgatttctcaggtacgactttcagattcttgcgttatccagcacctgtcaatgctggcgcaagtgaagaggagaaggataaattcagagatttgaacgttgctggcgcacatacagactatggtactgttactttattattccaaaagaaggaagaatctggcttacaattgtactctccaatttctaaaaactgggagaacgtgcccttcgttgatgcatctccaaaatataaggcaaggggtgaagcggcacctctcattgtcaacattggtgaccaattatgttactggaccaatggacacctaaaatctaccattcacagagtcagatttccaccttcacttctagaccaggggaaggatagatattccattgttctttttgcctgttcgacacatatttttcctgtataattaaaacttgtagagaagttaaggcggtggctatttccgatcggaggtggtgcttatggtgttaatcctttaaagcccataattcctaacgaaaggagtagcctaagtgtccgttgcggacgctttacaattaatgctggctttcggtacttttatcgtagccttgatcgcattaattgttgagctgatcaaaagtcagcaaaaaaaataaccgccttagcttggcacagctagcggttattttaagtcgttaattaatgccaccgtcttaaacggctctacatgggaagccctgttcacgcggggcttcctttttatgcctttattatagcatgactacagctggatttcgactatttttaatcagcttctttagcagttttaatgtgattaatcaacattaattttcttaattaaacggccaccacggaaatcgtttagtaatccgtcgttctgcatgagtatcgtaagccacataatgattaccagtttgttcacgcatcattagggggatctgcgcacgagagaccagacgaatatttgaaacataggagcctttatgagcaacaagtgcccaacgctgtttagaactatattgtccggtataaaactttagccaactaccactaccaaaaggatcatcagctacaaacgcatcaactcgctgtggggttttaacagcagcaacatgcttgtttttaccatcactatcaatgatagttgtcttttccttcttctctagtacctgattagggagtaccgcataaccatattgaactctcaaaaaagggttgaagcgatcaatccattcattttgcgtggcacgcccaaaccctaatatacttaaccataaaaacagtagcacaataattctcaacacaattagtaagtagcgtttgtatttatttttatcccgcacatcttgactaattttattaaccataatatttccatcacctttaagtaagatatctagaggaacagctaaaaattcacttaaatttactaatgtgtctaaatttggataacttaaattattttcccagcgtgatagcgtttgacgtgtcacatgtaatttatcagccaattgttgctgggttaagtgcagttcttttctttttttccgtaatacattagcaaattgcaatttaatagccctccttaacttttaagatagcagaaatctcgcgaatgtaacgcaattaccatgttacattgcccgttttcccgtattaaacgaaagaacactgattccatctggcaatggcaaccagaaaaccacgtctgatatttttttgtggtgagcttcattggagtagcgattacgtaagatagcgacccttcttgaagctaactcatttacaaatatcccatgatggttaagcatattccctaatgtgttaaaattaaattgtgagtatctttaaggattaaggagtgaattctttgaaaaaacacaaaaaattaattatctcgttaatagtaactatgctagtgattatttctggaggaatatacataggatatcagtatggccctaactttaacttctacttggtcccaccaacccctaaaagagacgccatgctggcttttaataaaatatcgtccacagggatctatacagaaaatcaagcgcagaaaaataggatgacagagattcgcaataacatttcaaataagcatacctacaaagaaatttatccactgttaaaacaagccttggcaattaagggtggtaagcacgcttctttgataactccatcagaagtaaaaaaagaagtttcacaatacaaagccccaactagcagtgttaaaaataatatcttatacgtccacttaccagaattcagtggatcatcatcacaaggaaaaagatacgcaaacacaatttattataagctaactagtaaaacatataagggtattatcattgatcttaggaataacctaggtggtgacattggcccaatgttagctggaatttcgccagttgtccctaatggaaaattatttgaaatagttaattcggcaaacaatcctacgagtgtaaccttacacgagagtgttactaacaacatgggaactaagatagaactcggcaaggtaaaaaaagtcacaggaatgccggttgcggtgatactcaatcgatggactgctagttcaggtgagctaacagctttagcacttgaaaccaatcctaacgttaaaacttttggtggtgactctgctgggtatactagtatcaatgatacgtacactatgtacaatggtgctcaagtcaacataactgctgaaaagatcaaaaaaaataatgggcaagtactcttcaataataaaattaaacctgacgttcaaactaacaagccaattgttcaagctgacaattggctattaactcaaaactagtttttggttagagatcggttgatctctagcttccactgtataatagattaaacaagaagttttaagggcggtggctgtcttttcccttgcgaggtgaggaaaagatagttacgtagattactacaagccagcctattgcagtaacatactggtttaacgttttagccgtcttctcattttttacaatagcattaatcagccctttaataatttccaatacactccccaaaattgctccaataataaccattttgattaagatgtactaggccctgtcaagttgacaaatgaaataatataaattttaacatgtatctaaatggcttcattccagtattcatctggggtgaggccatttctttgtgctgaacggttgtggtgattaaagtagatgattccttcttcaactaagctcacaagttctggataggttttcgccattgggtgacgatccatccagcgtagcttaaattcattccaccaacgctccattggtgcgttatcatagggcgtgccaggccgtgacatactacgtctgacctggaattgatccataaattggttaaacgatttcgaggtatatgccgtgcctcggtctgtatgcaccattggatgcacatcgcctgcttgagtaaaagcccgttgaaaaacttgaatttctgcggcacttgtttccgtaatgctgagattataggccaaaagtcgccgaccataaagatccaaaacgccgctcaggcgcaccttgtattcaccgttaataccatatgacaactctgttgagtcagaaagccagacttgattgggcgctgtcactttaaattttcgattcaatacgttgtcctgaatatactgttccgattgctttacacggttatgttttttcttgcgaatctgacaatgaatatctagttcacgcattactcgacggacctgcttaaatgtaactgggaagttaatttgttcatcttggcgtaaattttccaataaattaccagctccaattccttgatgatgaaaatcaaaccagtattgtgctcgttctttaagtcgttgatcccgtaattcccaaacagtttcttggcgtttgagtcctttgttgtatgcttgtcggctgacgccgataattaccagtagctttgtgattgctccatgatgacctttactgacgtccttaattgcctggtaagccagttgatgctgttttttcaccccttgtaccgtagttcctgaaatttttttatgaaggcctcataaagttctttgtcttttaattgcgattctaactcacgaattcgtaaattagccttatccaaatctgtaagtgctgcttgttttttgtgatgaccacgattatctacgaggaattcatagcctctttcatgagccttaagcacccaagaacgtgcttgttgataggaaacctaaaaatgagtggcagcttcgctataactatgtttatctttggttacatactctacaactgcaattcgttcttcaacagtagtttttctacccatagtgaggaccaactttctagatggtgacatcgtcaccgttttgtcctcattatacctggaaatccagtttactaattgacttgttgaacgtaaaccaaatttaagagccacttctgcaagcgaatagtcaccatttgaatacgtgtgaattgcctctaactttaatttctgtgaataatgtttattctgacgtgcttcttttaatccctcaaaaccatcacgctcataacgttttaaccacgttctaaaaacattaccattaacattatgttctctcgaaaaggcctcactagacatttttgattgcctgaattgctcaagcaaggttaacttttcaagttctgtatacttagctctgggcatacaaatatccctccatagttattagatgaattatattatttcatctgacaaccataaagggattattacaagaaataacatagtataaaacccctttgctttttattttataatatcatcaattacctatcatgtcaggatcacccccacatacgtggggaatactaagacttgccgtcgttaactgctgccattgtaggatcacccccacatacgtggggaatacctcatgtggtgtaacccagcacggacgcgatagggatcacccccacatacgtggggaataccgatttaactgctgtggattttctttgatcagaggatcacccccacatacgtggggaataccggttccaagcgctaaattacggttgcttatcgggatcacccccacatacgtggggaatacactaaacgatccccgtcataacagcatttataaattagtgaatgccagttttacatgagtttgattcctaattcaagagttatttgagcaccagataatacataatatgagctgcttttaatttaaaagtggtcttcataaataatggtgcctacatgctaataaaaaatagccgctttagctccgcaagctagcggttgtttaatatcgtcatatagctcgacataggaatccttgttcatatgggcactcacagtatagcataacaactggttaacgttgcacgccttgatccacctgcttgctcttatgtttttaagttttgttatgattattataatgactataaaaaagtcgagaccgatggttatacaaaggtgttcgttttagattcgtggattaatcagtttgctcaatatccggataagtttagatatgattcaacgaatcaaaaattgctcaatccgggtaacttaccaagcgtttcattgaatcaagtaagtacagatgtaacaactttacaaactcaattacaatctttgcaatcaacaggtacgcaaactgattcacaattgggagctttggtaagtaacatttcagtggttcaaggacaaatcctcggagaactacaaaatattaaaactcaattaaatgcttctgaaaaagcaactgctgtaccggcagcaaatacaactaattcaccagcttaataaaaggaggtaatacaatgtttaatattgattggcacggaatgcttaaaattgaatatgataacggttggttgtcttatgataaattgaaactgttcgttggttggaatgaattaacaaaagatcagtttactgatattactggtaagaattatgacacaggggtggaaaattcatcaactgcttcttaattgacggtcagttgagtacactcacatgtagacgttttttggaatgcaagtttaattaaattaaagtccgtcacttttttggaacagtggtataatcattttcgtaggcattaacccctttggtgcctacgcattcgaatatccatctgagcatttatgaatgccccatgctcatacattcccctcaatgtatgtgatgtatacacgcccgtcataagatgggcgtgtttgttttcaataattagttgttacgactaaataatcgtgatacaatgcgtttgtggaattccattcctccaagaaggaatttcatgttcttcaatatgatatgaattgaggacgccctttaaagcggggcgttttcttttacacaaattttatggaggttgtcttatgtatacacaaatattaaatgttttaaattcctttaaagcaaccggattggttgcttttttaattgctgtaattccagcaacttacaaattggttaaaccgttgattgaagctaaaattaaaactgaaaagaatactcatatcaagcaagggatggaattaggcttgaaattagcgaatgctttcgttcctgtggtggcaagtatgcctgctttaagtaactcagatcgcaaaaaggcggttaaccaatttattgattccaatttaaaaaaatccggctttgattttaaagcagaaacaattgaaggattagcagaacaagcttaccagtattataaacacactctaaagggagataatcacaaagcacctgttactccggcgcctacaaatgacgttacacccgacgttccagtcgatgacgatccggaagtatttaacgaaccccaatcatctgaacaaaagtaggaagtgacgaaaatgacaaaaaaggttgctgatttatcagtatttcaaggaagctccgagtcttatatgaagtcactgaaaagtcacggaattgataccacggtggttaaattgacggaaggcactggatacattaaccctaaagctagagaacaagtggctaacggattcaaagtatttggtactgtgagtgtttatcatttctttcatggtcatggttcatcagaagctaagtatttcttagcttgggtaaaaagctttgggttggataaatccacagtcttggccctagatgtggaagcacaagaccttccttggaagaccacagctgaagtaaatacctttttaaaggagttaaaagccaacggatttaccaacgttattacttatggatccggttcatggtttgctgaaaagcgaattgatcgagcgaaacttattgataagcatatttgggtagcggcgtatggtgttagtcaaccgggaattgataatgcgaatgcctggcaatataccgataactatgatggattaaaggttgacgccagcttagattttgatggttcactgtccggaagtggggtagttattaaacctgttaaaccggaatattatcaaactccaggcctatacgaagcaacacaaagtgtgattcaccaatttaacgatgctgaattcaagtctaaacggcatactcgtctgattaaaggaagtcgattctatgctaccccaataaaatatggtgaaatttatcgcctttctacaccaaccggttactatacagcaaacaaagataaagttaaatttatctttgcggtaaaggctggtggtaaataatgacggcagttcctgacgaaattaacatgactaaaatgctcattggcattaaagaagatatttcttccattaaacaacagctgaatgatcaggctgatttgaatgctaaaacagataaagctttggctaagtctattgaaaatgagcatcgaattgataatcttacacatattaactatgcattaatttctttagtggcaacgggaattattgtaccgttgattatttatttaatttatttaatttatcgcgaaaattagcccataattgatccggcgtcgcaccatacaggtcttttcgttccacccattgattacttccggtcgttaaggttttaacaacttctttttcaaatgacagttccaacataaaaacattccttcccccagctttaaattactcactagtttattatacgcgaaccaattggcgtttaggcttcataatttaatatagccaggatacaataaagctaaaacagagaaacagctaaaaatataagaaactaatattggactacctattaaattcgaaagagctgtttcaataaagttattatgatcctcataacacaaattcaaaaatacattttgtgatattcttgttaatataggattagtatgactggcgttaaagtgagcattgtgaagtaaagtgagttaaaacatggacagatgcctcacaacgttaggtagtcgaacgatccttagttggttagagaattgtcggcgactttggaaaaattgtgagcgtcaattaaccaccagtctgcaaatggtagttttagcgtttttagcactattacttaagagattttagacagcttcttatggtatatactttttatttgtaagttaaggaaagggagatcattaaaatgataagtattaaaaatccaatttatattgagaattatggatacacttttaataatccgcacgattttagttatttagtatctttctatggttcaaaagatacctctaaaagcttgttcattaatggcaatacattggatcaatatgttggcgatgtacatgcattgattaattcataccagctaaagccggctactagggcagcttataagccactttattatcaatcgtcggttattattgatgataacaaagttaaagcttacttatataactatcgtgatacactaggcaagaatatcagccaggattataggctgatcaggttagctgtcaatagtgctaagccatcgactctattgacaccagatccaagaacaagtaatgacaccggttttagtgatatgcttaatttctggagcggctattctatgagcggattatttaacaggaataaatggtaattagggtattccccacgtatgtggggaataccctaattaccatttatttccgcttgacataccttaaagtggctataaatactagaatggttctataatcaattaagccaatttattaatttaacatttgaggtagatgtatgatgacaaaacgaaataaaattttaataaccgcaaccatgattgttggtgcggtagttgtgttagtagtggcaggtattctttttttgtcgccaagccgttcacaacagatgaagcaacaatcaacgttggctgtgaatcgctcgaccacaccggttttgtttgtgcatggttggggagccggcttacgttcccaaatgccgttggctagaaaagcaattagggaagggtatgctcaaaagggactcgttgtctatgtagggccatcaggtcaaatccagatgtatggccgtttacctgtccatcccaaaaaatcaccggaaatcctggttaaatttcccaacgcctacatcggcgaatacaaagaagccgctgcactgcacaagattttgatactgttgaaacgaaattatcacatgacccaatataatgcgatcggccattccatgggtgcctatgcgttaacctttcaagctgaaaaatatggtaactcaaatcaattgcctcggctgaacaagctggcattaatagccggtccgtttgacggtatcctgaatcgacacaaatgggatcaacctttgagtggcaagttgagtcggctatgggacgattattctgggcaaaatcgattgcttgctaatggtcagcccaagattaagcatcctgaatatcgtgtgttaattcgaaatcgatatcgctttcctcggcaggctaaaatcctcaatattttcggtcaagtcaatgatggatctgattctgatgggaccattagcgtgccatcagctctatcactgggatcaatattgaaaaagcaagttgccagttataaagttcgcagcttttcgggacaactggcaaaacatgctaatcttgagaccaagaatacccgggttcaggagacgattatgaaatttctttggggataattgttggtgggctttgagtgataaggttcattggcattagaagaagtgtttatggtttataaaggcatttctattagaatgacttggaataaggattttccaagctgttttgatagggatgctttttagttacttagctaggtggctcaattttattgagcgtttttggattaggcgtattgctcctatactgaaatttggtaccaaatttcagtataggagcacgtagaagttatggaaactgagtggatacccatactttaaccaagcccaaaaattaattaaattaggcagtgctcttcttgcaattggctttggtaagaaacaccttagaaggtgaagatggtgcggtggataagtcacgcaatgcattctcaacggaactcaaactcagcaagggactagaaacatccaagatgcgggcagcagctgagggctcgttgaaggttttgagataaacaagaccgaagagatggtcaatggtcatcccatgggaaaattgggttctgaaggtcttgagcaccttcagtgcctgcgatggttgcatagtagggacctgcataaaggcatcaaccattttagaaagctggcgcgccgacattgccgaaaaatcgcgccgaagagcctgtaataactcaaaacccgacaaaccctcacattggaaatttgcaataatgtctgcgtcgactgtggtaattaaaaccacatggagggctcggttgaggtagctcgaaagttgtgtgacagtaagctcctcgatcgagccgtcagtaggaataagtaaacttccatcgacgaaaaactcccaaagaccgaggccataaggaaccaaaatactttggatgcctgcttcccacgtgtgaaagttttcagcagaactcaattggaaagtagagttctttgggcacatatgggcaaaagtgctcataacctgttgtattgagactatcctggtattgatatccattgaatgagatgcttgttctgtattaaaggaaactaaacaaaagtaaatatgtggaaaattccactgtaagagaagaaaaaggaagagtccatgaaaggtgggaaccgccctttatataagaaaatctaagcgcgaattttgacgcccctcgcgaaagaaaaatttccgtccagggtttcattttccgctcagggtttggtttacacttcatacttcaacaccctaccataaaccaaacgctcaaatgctgtggacattagtatccctaatgaaaacttcgaatttgagtctaccaacattctttcccaatatagcgacatccatgccagcagtgcgagcaataaccaaaaagaattgccaatgttgagctggtcgcgaactgcgcgaagtccaatgccaatgtgcagggtactttgaggtgcatggtaaagacacgaccaccgtttgacacccttggtgttgctaggcatagtaaaaggagaaccaacaatgttactttgttccagttgagttgcagtaccattccaatgcaaataatggaacttggcatttgccctatcatcagacatctcaagcgcgaaagcttgcgtgcttttaataacggcagtatgatcctcaatacttctaatggatcttggtagtgctgaggtagcttctgtaaaattagagcgacagacgttagcagcagaatacgacttgcccaccatgctgcaaactctggagggttcagcatgagaacaagtggcgaaatcggtacccaaaacagtggacatggggtaacgaaagcgagacttgggatcacggttgcaaacagtggttggaaaacgcagtccctgggctggtgaaagcgcagctggaaataaggagccgctggtccgggtgcagcgtgatcgttggaggacggaatcaatgcaggtatcggacatctcgtcatagacggtagatatgccatcagtagaaactttgtccggagcgagtgatttcccagaagcttgtggtgaagttgatggtaccggtgaattaatgactggttcagttgaaatatgtaataaatctttgggtgtgattggtgtcgtggggacagaatgtgcagccatagcagaacttgtagaatgcaagccgttggcagtggatggcaatgaaaacgacggtagtgaatgagggtcacccttgaaataaggtgaacttaagaacgcagagaaaactttttgcttagttgggtttgaactggtgacgacaggcgcaaaggtgaattggtacaagtcgtcttcaatataccgccccacaattgtgccatcactcatagtgcaggtgtcggcagcaaaggataacacagaaccactaacagtggcaatctttgccacagagatcaagtttctgggggccgaaggaacgtaagcaacattgcttacagtaataaacgtgttgtccgggccgctgaatagaatggaaccatagcctttgatgtccaaagcactatctgtaacaccagagacacttccggacgacacggggcgaaacgtttggaaatgttcgcggtttcgtgaaagatgagtggtacctttatcaaaagtgtacatgtccggattgtcattagcagtgcgacgaacagaccaggaaatgtttgtagtctgtgtagcctgagatggggaagtgccagcagaactgggcttggcaagtggtgtaggggcggtgcaattgctggagatgtggcccttagcccagcatcgcctgcaaaccagtgaggttctaagacagtactttatctaattttgctaccatgaacttttcgtatcaactaacaagataagtttttgtggtttcaacccttagttactcatttgctggataacgttgatttaaggtttcgatattttcttgtgccacttgttcaaaaggaatgtcagcccattctgcaacctgtgataaataccacaaaacatcgcccatttcttttgttaattcgtcgcgatccaaatccttaccatgaaaagtatagtttttaactaaatcaacaacctgaccactctcactagctaaacctaaggcacaatttgttaaaacctgttcattgccaaacaaagttctgtttgcttttttttgataatcattaaattccattgttagtcctcctcgatacgcttctcaatccattgccaaacctgatccttacccatttttgtttgagctgaaaaaagttgaaattcatcgggttcgctaaaatggagtgtcttcttgatcaaactttcactcttgttccacttacctcggacaactttgtcacttttagtcgccacaattaaaataggaatttcataataatgaagccaatcatacatcgtgacatcgtcctcacttggcgcatgccgagcatcaactaaagagatgactcccttaagctgtggacgcgtggaaagataggtttcaatcattttcccccatttttctcgctctgttttggacacttttgcataaccatatccagggacatcaacgaagtaaagttgatcttcaacattatagaaattcaaggtttgcgtttttcccggttgcgaggaggttcgcgcatagctattacggttaattaaaacatttgttaatgaggacttgccgacattagaacgaccgacaagcgcaatttctggataaccagttgttggatactgagctggagccactgcactcatgactaactcgacattatgaacttccatttcttgtaccacctttttaatcttgtctaattttaccacataaagattgcaatttttaatcaaaaaaataatggtttccaaattagaaaccatcattcttttatttccagctatttaagaagctttcttatctttcaaaattaattctggttctgcatgatcaacaactgtgcgttttgtcaccgttacttgttcaacatcatcacgagatggaatatcgtacattatatcacgcataacttcttcaatgatagaacgtaatccacgagccccagtattgcgctcaatcgcctcttcagcaattgctcgtaaagcttggggtgtgaaatgtagtttaacatcatccagtgataatagcgtcttatattgtttaaccaatgcatttttgggttcagttaaaatacgaaccaagtcatcagtagttaatttttctaaagtggtaagaataggcaaacgaccaatgaattcaggaatcaacccaaaccgcaataaatcttctgggatcacttgttgcataagactcttggactcatcaataaccttatcagtatcagttccaaatccgataaccttgtcacccaaacggctcttcacaatatcttcaataccatcaaaagctccaccaacaataaataaaatgttagtagtatcaatctgaatgaactcctgttgcggatgcttgcgtccgccttggggtggaacattagcaatcgtgccttccaagatcttaagcaaagcttgttgaacaccctcaccagaaacatcacgcgtaatggaaacattttcgctctttttagcaattttgtcgatttcatcaatgtaaataatccccttttcggccttatctacatcataatcagcattttgcaaaagttttaaaagaatattttcaacgtcttcacccacgtagccagcttcagtcaaagttgtcgcatctgcaattgcaaatggtacattcaaaattcttgctaaactctgcgccaaaaaagtcttaccagatcctgttggcccagtaatactgatattactcttttgtaattcaacatcgccttcatcagcactttccatctgattaattcgcttgtagtggttatatacagccacagacaatgtgcgtttagcttctgtctgaccaatgacatactcatttaatttattgacaatttcagctggtgttggaatatcagaaaattcttctgcactctcacgtgaaacttcttcgtcaataatctctttacataaatcaatacattcgttacaaatataaactccgggaccagcaacaattttctttacttgatcctgagtctttccacaaaatgaacaagtaattgtccctgtgttatcggtgttatctaacaaccaactcacctctctaatgtttataagaacatcataacaaaaaccttggttttaagctaacaactcgttttaaaaaagaatcttaaacggctctacatgggaagccctgttctagcggggcttcctttttctgtttacattatagcatggctataacggacttgcgactattttaagtgtagtttctcaaaggctagagaaactattgttcgttcttgaaaatatgtaggagcaacggcctaagaaccatatatagtggtataatatgtaataaaaactatatgtagtgtttggaaggtgcaattcttggttcaagagaaacacaacaaactattgagcgcaataatttcgattggtcttttaagctttttaggaatagtggttgaaacagcgttaaacataaccttcccacaattaacaacgtatttttctatacctatcagtcaagttcaatggttgactactggatatatgctagtctcaactagtttgattccattgggttcattctttttaagacggtttcgtgtggtaactttatttagagtttcgtgcttaagctttttagtcggtacgttgattgcaagcttttccaacagctttaatttagttttgctaggccgcttatgtcaaggcattgctgatggaatcgcgttaccgttgatgtttgctgtcatactagatcaagtgccaaagaaaaaagttggcacttttatggggctaggtagcttagttattgcctttgcaccagcagtgggtcccatatatggtggcataattcaggacacattcaattggcattttctatttataattttaataccaattattatggttacctggctgcttggtgagcttagcattgaacaaagttcaccggttcattacgttccctttgatgtccgtgggggcattttcttggccatttttttgacaacgacgttgatgtttattgttaacttgactgctaacagtagctcttttaaattgtatttatttttactaggaacagctttttttagtggcttacttttccttcttaatgagaagcataagagccataaattgttggaattaagtctctttaaaaacaaacgctttttgcagttgttaagtgctttttttctattgcaattcagttctttgagtatgtcatacttaatccctaatgtgctacaaatactttttgcccagtcacctggtttggtaggttttctaattgctcctgccgctgtgattgatgcagtgctatcggtggttgctggtattatttacgataaaactgcaccccgcttacccattataagtggctgtataatcattggactgacctttttgggcgccaacctatttacaccaagtattggcgggctggttttaatatatatgctttttatggtgggattgagctttagctacagtaacatcatgacctatagtttgtctcaattacctgctgggttagtaaatgatggtaattcgatttatatgacggttcaagcttattcaggagcagttggaattgcaatatcgtcctctattgtttctttattgcagaaacaacaagggagtgtaatttcagggacaaaatgggggttagcaatcaatttcttgattttgttttttgttgccgtattcacaatttctctatgcttgatagctttacgaaataaagtaattaaaggagataaagagtaatgagtttagatgatataaaatcattttctaaagaaaatatggcctttgatccaactgggcatgattttcttcatgcccaaagagtggctaagttagctcagaaaatatatacagaagattttaaaaaagatgaaactgatattggtctgtatgttgtgaaagcagctagctatttgcatgacaccatagacgaaaaagtcactgcagataaaaagaatagactgagagaagtacgaattatacttagccatgagaatattgcaactccggctagagaagacattttagatattatccaacatatgtcatattctgacaacattgaacaccattaccagctttctaacgaaggtaaatgtgttcaggacgctgatagacttgatgcactaggtgcaatcggcatagcacgtgcatttgcttacggcgggcacgctggacaggaaatatacgatcccaaaatatcagtgaaggaaatcaaaacacacgatgattatcgccatcacaaaagtacaaccatcaatcacttttatgaaaagctactgaaattagcaagttcaatgaataccagaacgggaaagcaagaagccagtcgtcgaacaaagtatatgcgtgatttcttatctgaattccaaatggaaacaggtgtaaaagatgagacataatgagtatctattagataaatcgtatttcgaaaaagtcgctgcgctttttaataaagggcagtctgatcccattgtttacaccgaatgcagcacactttcgtctgctctggtaccacggtgccaacactttcgtccacataccgatctgctacttatcaatgaagctgcattatagtgaatggctcctttgtttcctctgatcttgtcctaatcaacaagatcgcctataccaagactattgcaagcatctgtccgaaactttgaatgttctttactcctttgtgctatcagttcattgtttctacttatatggagtcgacacaatgcactctgaactatccagccatatatatgtcaaccgtggacagctgctcattcatattgtggtgccagtgtgtttattgacttgccaatccttgtgtgttttcatcttctcataccggttggttacacgacttagctgtcccaactgcatcagctctggtacaaccattcaagcagcaccgaaccatatgtcagttgtacgtgaaataatattgcctacaaaacatgaagtcattctacccaaatatggttgtactttcacttgaattccagaggtctctttctctactgcattagcccttcgttgtatcagcttacatgaaatcaatttagctttacaatccgcatccaaccatatgaatagaggcacgggtactgttgcatgaaggatgacttcgcctatctgtgaagaatcgatcaattttgaccaactttggagcgccatatctcaccactccgaaccgaacataactcatctcggcaatgatctctcttatctcgccattcactatacacacagttgaatgaaagcctctcaagatcccttagtgaattctgtcaggccagtttgttatcggtatgagaagtttgcaacttcaaatgtttcctgctcgacggctgttatgtttcagtacttcgacttagcagttgcatatgcaaattcacacactctattcaatggtatattaaccaaatatgacagtgcaagacaaaatcacacctgtcacagataattggtgtggaaaaatgtcagcttcgaaagatcactgctcactggtgctgaacttccccttacattgcttttgagactcttctacagcatccacagatctatctaaccagatatctctcttcgtggaagccgcaagcttgcaacttggaaagtttctcagcgccctatgtcattagttctgatgtttttggaccgtcgttacatccaggtagtaccactggatggttcatgcttaatttttctattacaaatttaaattttatataggttttatacttattttattgactacaacgatggtgagtgttataatagtaagatgtaacattgtggttaactgttaaagacaagttgcaggacaaattgatggattttctaaatgtggtcttttaatgagacttttctttttattgctattcaacatataatgttgactaacttgaaggaaaaaaagcttcgcacaatacttattgcctttgtttaaaaataggcgttccctagagagaaaggttatatgttccatatactttactctaatcagcaggaacacatcagccaggatgttcaactggaaagattggagaatatttctacgatttaacattgtatgagaacgtacaaccggtgggtagtgtcgacggtacatgttggcgtaacagacagcgcccgacatagccacagcgtatttttggttgttaaagtgcctcaaagacgctgaggggaaggaagacgataagttgtgcttttggcctttaggtgtttccgtatatcgtaaatgtgcataccggtcctcctgtaacgaatcaatgagaattccctcttatcagtttgcaggctatagtatgtacatgctcatcgtgtgtattcaatatgaccacccctatctactgattataggattgtcatcagctcaaggactctgctgcagaacaaagtatgaaactttgagctgttcctctaggatcagctaagagatcttccacatccattttctacgtaagggtgaatccgtttattgcataagcaacaagtacagacattgttgcactcatgctagatgttaatacttgaactgttcggctttcttgatcgtgagatctcatcatttctgggtcttatcttgctgtccttgttcttgatgggcctacctgtactctctttcttctatatagtcttcactacaactagctacacttgaattgtatgaacctggtcctgtacaaacaccagctgaccatattttgccttctgtctgtcgaaacatgtgcttgcagttcttgaagtctctcccgcctcacgccccaaaatcaatgaggcgaaggtggcgttcattcaaccactcaaggtgtctatttttgcttctaagcaattttaaagcgattttaatataattatgcatgtaacacttaaaacggcttaaacgagcttatacggcgtttaattccaagagcgctcattgtcagtgttctgttcttcggggtgtttagccgcatattctctagccgcttgtttattccaccaaacgccaaataggttttgcatggtgccgtataagtagttctcaacattcttgatgtgcttctcattgcttcttagaacgttaaagtagcgtctcaaggctttagtcattaaaggtttcagttcctcatcatcaagtgggattatgacaccaatatctttgtgatctttctcaactcggtacttagcatttaagataatgccaatgaagcgccgcatttgttgcggagtgcggcaccagaaacttagtaattgcacggcttcgggttctaagaaaaccggtaagccactgtcttcatcagttaagaagtcattagcatggttcaccaaatcctggttttgcttttgaatttctgctggtgagaaatcggctgtggaaaagtccaacttttgagtatctatattgtatctattagtatctaaattattagtatagtctagatcttgtctctttttgagaagtccgcttgtaccaagggattcagatgtatcagaaacggtatcatgcgggtttctctttttgagaagtccgtttgtaccaaggggttcaacggaatcatgcgggtttctctttttgagaagtccgcttgtaccaaggggttcaggcgattttaatggctctcgcttaatataaacgtcttttgctgttacttccaaatctgccaaatataatctatttggttcgtttttgcctgatcttggattaaaacccatatgtttttgatacaaaagttttgcgtccattaattcgtgtttaatcttattgattttattatttgaccagtttcgtaaatcttttagttcattgtttgtgtatatgaaatatacgttgttattttcgtcaacccaattattgctcagtgagtaacttagacgatcgcgtaacaccgaataaagtaaaatggcactatcgctaagatccttatatttttctccttggagtaagatctgcggcaaagcgtagaactttacttcatatgcccttttagcatttgtaaagttgaaatttgattgatccataataaaagctccctttcttaactgacacacgctgtcttaaaagagagttgctaaaacatctgacttgttttaaaatacaaatctggtatgctttaactgaattacaaagcgaacattggacgtgatcggctttgtaaattcaccggcatgtgtctattctgggttgcccatacggcaacttttttaatttctaacaacaaaaatggactaaatagcgttggttagccacttagtccattggatttaatttgtttttaactatccttcacttgtcccataggattggtttgcggtataattaacctacaaattaagaacaatgttcagacgatttttacttggcggtctaaatcgtctgaatctaagtagctctctattagctacttgctaaaccaaaaatccccgattcctcgtgaaccggggatttttctgtttagcttgatctcttattcggttgttaaattaatcttagtctagcatagcgcttacctacaggcaaccgtatttggttcagtgcactttactagcttttacctaattacaaattaattaaacagataaattgcgtatttgtttgattatttatttatttgtttaaccgctaaattgcatctatgattgaagctaagaattctgaacggtttttaaatccgttttttcgggcagccgtatccatttttttaagttgactttcagtaattgagaaggtcactgatcgcttacgctctacttcctttcggctgatatttttcaaaaatgcaactgcatctttcttgttgtctttcaatgtagtttcgtaactttctctcatttcttcgtcttttttatggttgaatgaatctaaactcataatctaactctccttacttggttttatttgctaattcttgaaaaagatgatcggcgtgttctatgaacttttggttttgttttaaaatggattcatcatgattggccaattcaaatattgaagcgtgccttgcagtagctttattaaagagctctctttcaggaattatagttgcgactgtttcatcgccttctatgtgttttagcaaatcgcgagacatgcttgtattatgtctaatcatattaccgcaatgtttcacgatcgaaatttcgattttttttcaaaaatttgaaactttcagattacgtaataagtaatattacctcattgggtcattttggaggctcagcggtccttcaccatctgtttatgagatgaaattgctcaaatcaaattctaatttactattaactagacattcctacaccattttctcatctaaactactttttcctctgtgttttaggcgatcccacactttctacagtgggtgtgtatactctactgacgatgtctttattttacagcatcacatgatagctttagctctttttatatcgacaaaaagctttctgaacggtctcttagcacagaaataatgtcatactacgacatattactagtaacgagcaaccaagcagatgcctggggactataggacagtttgcgactcgtgactcacttggttttcgccatctgttatcagatcgccaaaattcagtgtgtgggggactggtttttgcaattctattgtatctatttactcaaaaacgttaaatgggtggctggtttttgcaattctattgtatctatttactcaataattcgttactttgcttcaaaggggtagtttttaatataagcacgcatatagtacgcgtatatgcagcacgattggatgcagatcattcagaaaaagcccctttggggcgtctttaaggagattatttgtatattgtttggtgtataatgtgcacggttcataaatcaataaacaatatcataacgcgccttcttatcgcgttagaaacccgattattgtgcctcgcctgtactaattcctttcatgaacaaccacacgtgtgtgtatagctagaagctagaagtttgactgttttatatagctggcatgatccattcgaaaaatatttgatactatcttttcccttttctcttttactctgcgcttatattgatctcaaagcgttaagcaccacctgaactatcatgcagtcaccagttgaactggaaatttacatacatccattaactatcggggataccgtcactagagtacatgaacctgttttttacgctactgatagtttcaccaaggcaaagattccaaaccctacttagaatttggtttatctttcaaatgtttatgatgttgctaattcaaggggaactatccatccatttaagagcatggaaaacaagcaggactggggagttgttgaagatcagaacgagatagatgaaacggatatgaaaaaaaataaggaatgccaagactggatcaaagaaagagatgattacattctaaaagcctaggatgttcttaaaagcttgaatggtggtatcacatctacggaggcaggaaccgaaacttcacctggcatatcattgtcttttgttgacgatgacgaagaggatgtgcgtaccagttgtgatgattcattatcagtcgaagaatgcgagcagcttttgtgtaaaagtgtctcgttcagaaattcatctatttgttcgatactacagaggaaatcagagctgaagtaactgttgagtggtttattagaagaacgatcaaaaaggaaactactacctacctggagtttgtgatcgctactggcaagtctaaattcaaagagttcaaaaatggtaactgtcctgaattttcaatgtttgatgttgatcctttagcattttggagaacccaccatgataaatttccgctggttgcaaaggctgttagattgttgctgcatggtgcgataacaagtacacacgttgaaagaatattcacagtcgctacaaatctgtattcagctagacggaaaggtcttgctccatcctacgtttcctacctgatgcttcttaaacttaattatctggttgatgatgctgacgttgtttctactgctcctatcgatcttgaagagttcaagaaaacatttggtgaggacagcagacttgctgattacagcaaggttgaaaggcggaagcgttatagccagaaacgttccgatgctgactgatctttgcctcatttatatacctccttattctctctatacttcctttattactctgttttatctcatcgattcttaggtactgctcattaaccattagccccaacaaaagcacttacatccttccatcaagcctttctaaaatagcatagcctattatatttgcttcaatagtggctttgtgtgacgatagagttagcttagaagccggtccagtttgtagtcttagcgctcagctggcaataggccggagttaaggtaccggagttaaaacattgcacaacattggtgaatgttactgctcatctttatttgttacgtcactaattttcatgcttttttaaataccaccaagagccaaacccacaaatgagtgcgacgatcggtcctccaatcactagtacccatagtgctgttgatttaggaattggttggtttagaaaaacggagaggccaggaattcgggtaccaattccaagtagagaatcaatcacaataaaaatataaacaatgattagaaacggtagccgtttacgctcagctgtataaatcattgttgtgatggtaagcaaaacgagaatggttccaatcccataccagccaggtaaactaatcgcaagcggcgtttttaagaagacgctgccaataacgataccagcgaaagtaattgttccaagcacgtagctggccaattttatcaacttgtttttttgataagtttcttgtccaattaaccacaagactacgagtgaaaaaacaaagctaattgtgccgagaataatcagtttaccaaaatctaaatttgatgttggtaatacgatattgggagtggcaaataaaaggacataaccaatcaagatgtaacaagctagtttaaatgtttcaaagaatgatttgggtaatgtttggaggatttcatcagctaatgtttgtggattttttccaaaatagtcttctgcgttttgaccattgttttgagcgtcaattaaatcatgtaggatttctaacaaaagctgttcaacgtccttttctcgattaaaggttgacttcccacggatataagttagcaaatcttcataatacttttgattttcagaggtcaattttttgcgaagcaggttgttagctttgatcaaattatcgctattcattagtcgttccttctttcgttgattaggctattaacgttgagtgagagattagcccattgagttagaaaggtttttcgagcttgcttcccagtgctggttatatagtaatattttcgttgtgggccctctttggaaggcttagttttaccgacaatcagcccttttttctccatattcatcagcagtggataaattgtccccttaggaacgtctgtaaaaccatattttgaaagttcttggctaattgcataaccataataaggttgatgattaattagaagtagcaagcacccttggaaaatacctttaagcatttggctggaaatatctgattgggacaagtaatcaccttcttcactactttgcattgcatattagtagcataacatatctaactggtttgtaaagcaaactaggtagatatgttttaacaagcgctcaaatagtctgattacttagactgaatggctaagatcattattacttttattcctccacaaagtctagtgttgacaacggaggcgctacaatggacaaaaacaaaatattaaaagcagctcaactggcaaaggatgatgaagggaaaaggaataccattttaaaaagtcaaagtattatatttggattttactcgctgggtttactcttcatgctaattatccggttatttcggcatgaacctcttagtgatgtgttctttttgattttacttggcagtttaggcgttgaaatagcacaagtcatccagaaacactctctggcatctattctgacgtcgttcttcctaatcgtagcggtcttctacactgcatggcttgtggtaattggagggtagaagttgtcttgaaaaacataattttagaaaatcacttaaaagttgcgcgagcagaaaagagtctgaatcaaccccaactaacgaagttagttggggtttcacgccaaacaatcagcaatatcgagactggtgaatttgtaccgtcagcaaaattggcactgcttttatgtcttgctctggacaagaaatttgaagctttgttttattttaaagaagaataggaccgaattataacatatagccactagggtataccctagtggcctttcttgtttctgtgctatactaggaattacaagtgttcattagaactgtccaaaaggagagctaaaaatggctaaaatcggttatgctcgcgtgagttccaaggagcaacatttagatcgacagttagcggctttaaaagacgttgataaattatttacggataaattaagtggggctaacattaatcggccagaactgcaaaagatgctggcctatattcgtgagggtgatattgtcctggtcactgaattagatcgcttaggcagaaacaaccaggatttaacccagatcatgaacaccattcaaaataagggagcaaccctagatgtgttggccagcagaaaagtttattgacaaatttgcgacttattacactccggcagttttgatcattgcattgattgtgggcttggttaccaaagatttccgattagcgattaccgttttggtcttgggatgccctggggccttggtcatcggcgccccggtttcaaacgtggctggaatcggtaatggtgcgaaaaacggtgtcttgatcaagggcggtgaagtgatgaacacatttgccaatgtcgacacgttggtattcgataagaccgggaccctgactgaagggaaaacggcggttactcagttcaaagattactcaagagaccagttggccttgcgaattgccacagccgttgaaaagcagtcggatcatccattggcacaagcagttgttaaattctcaggtgatcatcatattccgtttgaggacgttcaagttgccgatgctgacacagtcaaaggccgtggcgttaaggcaactgccaacggtaaaaatgttttaattggtaatttgagaatgatgaacgatgaaaatgttgatttgacgtctgaacaacgtcaagacttggaaaacatccaaggcgaaggcagttcaacagttatcgttgccttcgacgggcaaattcaagccattcttggtatctcggatgtgattcgtcaaggcgttaagcaaagcctggcgacactcaagtcactcggcatcaagaagacggttatgctgaccggtgataacctgcagacagccaatgccgttgcagaacaaatcggcattgacgaagtccacgcagaacttttgccggaacaaaaagtcgaatacgttaaacaattccagcaggaaggccacaaggttgcctttgtcggcgacggcatcaacgacagtccgtcattagtgacggctgacatcgggattgccatgggaagtggaaccgacgtggcggttgaaacctctgatgtcgtcttgatgtcatcaggattcaatgaattgatccatgcatatggactttccaaaaaaacggtcatcaacaccaaggagaacattttcatcgccattgcgacggttgtcgccctcctgattggcttgattctcggatttatttacatggccagcggaatgtttgtccatgaagccagtatcctggttgtcatcttcaacgcaatgcgattaattaattatcagcccaaagctgccaaacttgatccagatcaattatcggttggcgaataggatgtatcattaaaacagtaaatgagatggaggttatcaatatgagtaaagcaattttacaattagacgcgctgtcatgcccgtcatgcatgcaaaagatcaagggcgcacttgaaaagcaggatggtgtggaaaacgtcaaagtcttgttcaatgcagccaaagtcaaaactgattttgacggcgataaaatttccgcagacaaattgtcagacacggtaactgatttaggctatgaagttcaatcaatgaaagtgaaataggtgaagaatatgacaacagcaacccccgaaaaattatttgaagcagaagttaagcaagcagatatcgaccaccataccccaacggctggtgcgatgaccggccacatcgttgccaatttggaagttttatccaacaaactccagatggcaaaatggtatgtgaagggaatgtcggcccaacagctgaaagtcctattcggcgacttacttaagcaggcgtacgaccaaaaggatgccttgggcacggtcttaatcgatgaggccttaattacgccaagtacccaaaaggaattcacagagtacaccatgctggaagaaaatggccagaacaaatatgaatctgtagagtggctggtcaacgacttcgtccacgactatgacactgagaacatgtttgtcacccgggcaattaagcttgctgaaaaagaagaccgtccagtcttggcacaacatttggttggcctgctgcaagataacaaccacaacatcgctactctgcaggccttgcttggtaagacaccacgagaaggcttggatgaggaagacgacgaagattaatcctcaatagatacacgaaaaaagttccgaagcaattttgcttcggaacttttttaatatcattttttcgaattcaaagattcaaacaaatcagcacaataacacaggcaatcgtacttgccaggatccaccagccaacccgataagctgtccgctgataggttgaaatttgttcctgacttaatttgtcaaaatcaggcatcctaagaagctgtccaagatctatgatttttgatttgcatacacaccagtgataataatatcatcaaaatattccttgttcttcaacaaccatccgttgaagaccaacaacaattaacagaaacaagctcaccctccatcaaatggggtgaaaacaacttgaatatactcaatttaacgtgcaacatgcacagccttgcaatgcattgaatctcacaacacatctgctagcgtcctaattaatatgtcagtgcgcatcagccactgaaccttcaataacagattggatcctcctccaaacaactgccagaccatccttgttggtatcccctcatcatcctttgcaagagtttagctcaaattctccaacattttcctgtttcctgttggtgtattacatcttaatacgagataagcttctcttccctgatcagatacctctccaattcggtctttgtgtactagttcatcatttgataaccatcaccagcaagtgataagcttgatcgagcagcgctgtagatggacccacatggtcactttctaaggctcgttcagcacacaaccacttctaacatcagactggcaacatcaacatgatcacccgaacccagggtgtctttccgccaacacatgattcagaaaacaaacagtaagcacctttgaccttcgacaagcaggccagcctaagtcagcaacacaagcaccgcagaagcggctcagggctcataacctgttgaagtatagctgttttaggctggttactttctgtatgtatatgtcaaaaaggttaagaggggttataaaaggaaccactaaataaacagtataaaatgaatagtgtagaattcagctcgtagaccccatgtgggggcgcatctcaactcttataggagcgcgcctagtgcctagcactatctccgaattcttatctttcatgattgattaattagaggcttccacataataggaggggctgtcaacacgtggttgcacagcctactccttgtcattaatgatgtaagaacacaaaagtaagatatgaagtcagcagcccatattggctgtagccatattatgacttcatatttcaacaccctaccatgagcttaccatcattaagttcatgatttaagttaacatcacttaccaaaaaacatcatagcatcattttgattgatcaaactttcagcagcatcttttcattttcagccgattttgatctcagctcatttcatcatcagcacttcatctctttgaattcactcttgcactcacttcatcttcatccttccatcttcagtaattcaaattcactcttgaatctaattcatctttatctttccatcttcagtaattcatgccattgaattcactcttgaacccaattcatctttatctttccatcttcagtaattcatgccattgaattcactcttgaacccaattcatcttctacaacagggaaaaatagaagccatacttatttccttgattttgtttagactgccagtaatatatttagcagctttcagtaattgcaaagacttgtatctgacttccttttaagcatgtcccttcattatctgtagtttaagcatatccctacattatctgtagtttaagcacctcccttcatcatctgtagtttaatattcatcaatgtcaggtctatgttgatactttactttacctttccctaccacattgataatatttcaacctttcaattcaatagacaaacacgtcccgtctcttacccttcacaaaataatttgcataccgtaccagtaccttcttgcacacattcttgggtaactcttctttcatgactaggtctcaccttacgtaaagccctaccataccgtaaatccctgccacaccaatgaggttacataccttgcattacaagcttaacatgtgatcctggtctctcctagagctttaccgaacatttcaaactctcctaagagtaactgacttatctcaaactctttcctaatagtgtctgaaacattcctcatatattctcctaaaatccaacagagcagtgcctctgcttcattccctaccacactcacaagagtaacaacagtgaatcattgtgagtgcaaacacaccataaacttctttccttttcattccctaccacactcgcaagagtaccaacagtgactcattgtaagtgcatacacaccataatcttctttccttttcattccctaccacactcacaagagtaccaacagcgactctttgtgagttataacactcatagccgaatgagacattagggtgtaatagatcaaacgtgtgagacattagagtgtgacacagtaacttttaaatcttaatcagatcaactagttgagtagttgcccagaaactgacgtcagaattaatatgataagaaggcaaatatatgaaaattggttatgctagggtgtcgtctgaaaatcagaatttagctcggcagattgaagctctaaaaaagtctggtgtagagaaaatatttcaggaaaaggtttccggaaaatcagttcaaaatcgccctgaattgcaaaaaatgttagagttcattcgtgaaaaagatattgtcactgttttggatttagatcttggtagaaatgctcaggacattactgacaccattaacttgattcaacaaaaggaagccacactagatgttttaagtttaccgagtttcactgatatacaagatgttaacttacgtggtttattaaccaatttggtttttgaaatatacaaatatacagctgaagaagagcgcaacaaaattcatgctaggcagaatcagggaatccaattagctaaggagcgcggggagtataaaggaagaaggcggcaatatagtccacatggatcaaaacgctacctatataaaagggtagttcaaatgctcagggatggaacgaatattgcacaaattgcaaggagtactggcgtacaacgacgacaaatttatcgtattaaagaatatgctttaaaagttggagacttaggcactcccaaaagggaagtgaatagctagggcctacaggacaagttagtgttttttagggaccatcggtcaaataataaagcacttacattgataaaacattttggagatgaactatgttttttaaggattggacaaaatacaatagtttcgaattagttatgattacgttgggatgtagcatttatgcgttcagtctagatttagtctctattccaagtggcttggcagacggcggtctgagcggaataactctgattattcgtcatttctttcatattaacttgggaattagtactttatttctgaatattccattgatactaattgggttgcgctacttaggcaagcgcatgatggcttacactatttatggcaccatttgtttatcactatttctaataatatggtcacagcagcctctgattcaaccactaccattgagaaatgatttattattgtcatcactggttgcaggggtattatcagggttgggaattggtctggtttttcgttataacggaactactggtggtagtgatattattgctcgggttggccagagaagtttgggattttcttcgggaaaaggaattttgattattgactacgtagtattagggctatcactatcatacttagatctgtatcacatcgcgtactcgctaattgttagtttcgtattatctaaagtaattgatatggtccaagaagggcccaatcgtgctaaggtattattcattgtgtcagataaaagccaaaaaatttcccaattaattgatgtttctttaaatagaggattgacatatttgcaagctgaaggtggttatcagcatgatcaaaagcaagtgatttatttggtggttcaaccgcgggaaattccacaattgaagcaattaattaaagcgattgatgaacgggcatttgtgacggtactggatgcccatgaagtgattggagagggctttagttatcaacgcaaaagataccatgttaattggcagcacagtaaagaataaaaattaatagacgttttaatatgaaaaaacggctataatctactagtcactgattagaaaattgttgttttgatcacgtagagcagttgggtattgaacaataatatatgtgaaaacggccaggattcaaattttatagttttactattgagacagacttgaaaccaataggtgtattttttacaagccttaagttttgacaagtatcaagtaactattttttgaaataatgcggggaaaattatgaaacgaaatattcagtctatcggaaatactatgctcagtattatcagtagtacagttgttgtattaccatttatgattttttgaaatggggaagtagtcatactgttgttgcagttttgccatttgtcatcttttaaacgtttagaacaaccgggattttattcgtggcataagaactaagataaatagctatattgttggaatctgttgggttaccgaaatttgagactttctacaaaatggtgggcgttttctacaaatactgcaatccgcatactttagttttaccgaacatgtcctttgtaatggatactcttcacatctcggacaatacacttactatcattggtgcgatgatgcgagtatcttgcaaatatatgaagaataccgaggtggaggatgataaatttttagacgaatcgtactgggatgcaatgatacacaaacacgaatccaaatgttcaacgctgtacactttattatcacagatcattcaatgtgctagagctgatgatgcatacatccacagatgcattgagatcatgactatatcccgaatggatcaattcttgaacaatgccatgataaaaaaaattgagcacctgaatatcaacttgagattaaactccaagtgtttgttagatagagagattttgattagagtgtactggaatgttttcaaagtgcaggctttcaggaggctctcatttgggtatccttatccaagaccagacggtgaaccaattttgaaagtaaccaaagatatcgaggttcccataccggatacatcatattacaatggtacggaacatttggaacttttcaagtccgtgtatggtagaagcgtgcctttgaacagcatcagcactgctagcccagatggatcgaaactgtatgactcagtgtgtttagtgatgtctttacttttacttgaggaagtgactgatgccattgccaataaaactctgtttgattatacacttctgaagtttacggatgccattaagaagatataccagcttcatagcgatgaactatatgaacatttgaagccgtatagattggagaagcacaatggcggcaagcctgtgatagtgatgaattcatccaacttcacgagcgcattcataaataggatgacattgatgatgatatctttacatttcactatggatttgctattatttcagccgaaaaagattgggaagtttcgatctcaggttaatttatgcgatgattattcaattgtggaggttgatccaaaactgattttcgagaagagtgctgaaatcaaggaccccaaactcaggttgaaaagctggtcttggttgtttaccgccgtcgatacagtccgtctcatgattgtgctgttacaactcggtgatggtgtgcacatgcctcgtataaatgagaagagatcacactatgatgtccatgagtctgtaatgggtccctgttgttgtggtgtagatgattttgccaaatggcgacaatataacgagtggactatgaatgcttccaacgtgtcagtggagaatcagggatggatccagatgcatggaattactgtgtgggcgtttgcgcaggcgttaccgatatttgcgactttttctctggcactacttgaagttgacgttgtcttaatgacggaagaagaagaaggtgacggcgatgaggaggatgttactgcggatgttgatcaggagaaacgttatgagacgtttaccttcttaggcattgattacgatgcttacaagcgtcgaagttttaagataatacgaaaggataatggtgcagagattgtgagagggattcggtttactgcagcacctgcaatctttgcattgatactgatgcacaatgatgcaaatatgatggtgagccattgcattgagcggatgaagttggcgcagaagtttttgaacgtgctcggtaagtatcatggagattgtcgtatggtggccgcttactgcgataagctcgtggactatgttgtgcggttggtgagggagagaggcacggggagtgccgaatgatgcagacttgattagaacagtggagtgtatacgattaaatgtgtatgtatgtatgtatgttagcgttgtgtaatgtattattaatttgaggtagtgtaagtgtaaatgtaaatgtaaatgtaaagtatgaagtaaagaagtgaagaccggaccgcccgccgcccagtaaagcaagaaagaggggggttctggccactacttgtagcgtgttatcatgccctcgcagctgttagtcatgacgtggctctctagccaagtcttgtttgagttgaactccttaaaacaagctgcacagcgacccttcttatcacttctatcgccactcttggtacccgttgggtaaacaaaatggattgccttgagatgtcagaaatttttgaagataaaactgaaaatggcaaagttagaccttggcgagagcggaagattgaaaatgttcgttatgccgaatatttggcaatcttagaatttaaacgggcacatgatgtacggggttgtggtgaagttttgcgttttcgtaagattggcgagcacttaaaactttatcaaacgtggttttgtcataaacgattatgtccattgtgtaattggagaaagagcatgaaaaattcgagccaattaaaacaaattattgcggaagcagttgcaagagagcctaaaggacggtttttgtttttaactttaaccgttaaaaacgctcattcagcagaggagttaaaagtgtctttaagagctttgactaaagcctttaataagctaactcgttataaaaaagtgactaaaaatttattgggttatttacgttcaacggaaattaccgttaatgaacaagatgggtcatataatcagcatttacatgttttggtttttgtgaaaagtagttattttaagaattcaaataattatttagcacaagcagaatgggcaaaattatggcaaagagctttaaaagttgattatgagcctgtggtgcatgtgcaggctgttaaagctaacaaacgcaaaggaactgactctttgcaagctagtgccgaagaaacggcgaaatacgaggtaaaatcagctgattatatgacggctgatgatgagcgtaatttggtggtgattaaaaatttggagtatgccttagctggaacacgacaaatcagctatggtggattattaaagcaaattaagcaagatttgaaacttgaagatgttgaaaatggtgatttagttcatgttggcgatgaagattacaccaaagagcaaatggaagctgcggaagaagttgtcgcaaaatgggattttaataaacaaaattattttatttggtaaagagaatgtcaggatatgatcaacggtaaatccgttggcatatcccttttttgttgtcagcttgctgacttctgatacaggctttagcattactccaatttatttggagaaatgaggttggctttatatcaacgtttatgagcataataggtgagtaaaaagtacatgattggttgaagggagattcaaaatgatttatatatcaggatattttattgcttttttaggtctgataattatgttgtttaatttcaaggatttatatccaaagttaaatatatggtgtcgcttgggctttatccttttatgccttggtcttattttacctatgctttttggatttattactggttttataaataatcactaaattaaactgcccgtaaattttgtaaagcaaaataaatgcgcacttatacgtcatctttgatgacgttgtgctaaacccatcaaaacctgcatcagatttcgcgttgctcaaacgtaactgacttgcgtcagtttggaacattcaaaaataaataagttcagtcgctagctccttcgaacttttttatttttgaacgttaattttaaaggctctcatttgcgttctaagcgattttagctaacagtgagctatctaactgtctgtcaacggtaaatcgacttagaggggcttattgagccttacaggcgatattagcccctcttggaggctttaaggagttgatagactagacaataccaaaagcctgacgtcttggaaaacaagcccttgttttcccgagcccagcggcggcaagcgttacggtccagctggttcagctggtcagtgtggctgaaagccacggtttaaaaaaagcagttcagcggtttttgctgatctgctttttggggtttaaaaacgccaatttttggcgttttcttcttatcttgatactattagcaacaactagttttttaaaatcaagcttgattaggcttgattaggcttgtattccttgattttataggttttcggtgtattattagggttataaattggttgaaagaaagacaaaataaaaacccacgtgaaaatctccgattggcgtccgagcacgtgagttgtttatctttttcatttgtagcctttattttaggtgtaaaagcctttggtgtcaaggttataagcttattgaaaaagatagtcagctccttcacgtggtaaagcggaaggagcttttttgtaaaaggcacccgtaaaatgtaggaaaacggcaggttagaactgttggttttcctacattttttgtatcatgaatcacatcagagtgtaggaggaatttgatgtgagacgtgatttaagagaaggagtgacgatttacgtgactgaaaatattaagcctaacttcgccgagattgcccggcaatataatgttgattatcgaaccgttaagaaagcctatgaggaagtcaaagctggacttaagggccgaccaagtggtcgaccgaaacggccaagtttactggatccattcaagcaaaccatcgattcaaagcttgaactaaattgttcggctgcttcaatttttaaatttatccagaagaagggctttaccggcagctataccctcgtgaaagattattgtcgccaaacccgccgagaacgagttaagaaagctaccattcggattgaacattcccctggtctctctgctcaagttgactggaaagaagaaatggccctagtgagcagcgagggtgagctgtttaaattcaatattttcttgtatgtattgccttattcaaaactcaaatatatgacactaacctttgatcggagccaagataccctcttttcttgcttacacgacgctttccttcataccggaggtattccgacggaaatctggtttgataatatgaaaaccgttgtggatcatacaaaatcccagtttggccacgctgtctttaacgaacggttccacgaattctgtaaagatgccggtttcacaccaattgcttgtcgaccattcagaccacaaactaaaggtgcagttgaagcccttgctcgcacggttgaacgtttacggccatacaatactgaatttgctgatggaactgagctaatcgaactagttcatatgctccgagatgatctaaatcatgaaacttcgcaggccacggacgaagtcccgtacctgaaatggttagacgaagaaaaagagtaccttcatcgcgttccagttaatctccttgaaccatacttcgaagaaaacattacccgtgtcgtttcgaaggaggccatgatcaatttccgcaaatgtaagtactcagtagatccgcgatacattggttgtacggttgctgttgaaatctccaatgatgagcagcgcatccacatttattataacggagaagaaattcgtacgcactccataactaccaattcgctgaattatgacccccaagatcagttcaatatcctcaaatctgatttgcttaaagggcggacagatgaagacatttcagcttacattcgtgaacatatgactgattacgacaacttataggaggctaccatgaccactaataatcaaattcttttaaataatcttgagcgcttagggttaaacaaaatccgtgaatacttgccgaattaccttgatcaaattcacactgataatctgtcattaactgaggcgctaattgatttaactaattcggaactccagaatcgacacgaaggtcagattgcacgggccattggccgtgctcggttccccaatacaaaatccctagatacatttgattttagctttcaacccagtattaatcgccaagaggttctggaattccagaatctggcttttatggaaaagtctgaaaacttaatctttattggcaatccgggagtcggtaaaacccacttggcaattagtattgggattgaggcctgtaaacagggctgtcgggttctctttattaattgtcatgagctgttgattagattgagagcagcttacgaaaaaggactgcttgatcgatctctaagccgctattcgcgctatgacctattaattattgatgaaattgggtatttgccaattggtcaccaagaagctaacctcttatttcagctagtcaatgcccgctatgaaaagcattcaacgatcattaccagcaatagtgatctatccgcttgggttgatattttccagaacccaactgtgacagcagccattctcgatcgcttggttcatcatgttcacgtagtgaagatcactggtaaatcttaccgattacgtggcctcaagtaactgccgaaaacctacatttctttctgccgaaaacctacatttttaaactgcccttgacccgacagcttcgtgggtgtaatcgaaaatcccgattgtggcagcggcaccgccaccaacggcgttaaacagcgaaaccaattgaggaacatcggtcattggcactttgcgtgcgcggataaccccatacaaaattccgattaacagaccggcaaacaataccgtccagccgatcaacgtaatctgacctttggagataatttcaactaaaatcatgacaactgccatggccatcccaagtccggaaagtaaattaccattccgggctgtctttggggaacgcatcatgtgaaccccaatcacgtagcagaccgctgacagcaggtaaattagggaagcaatcgttttaaggagtgacattatttgtcgcctcccttgtcagctgaattcggctgttttttcggccggttaaacattcccagcatccggtcagtcacggtgtaaccaccggcgacgttgacagctgcaaagaatgcggccagaaaagccagcaggtagaaataccagctgctggcttctgcagcaattacaaaggcaccgacaacgacgacaccatgaatcgcattggcaccagacatcattggcgtctgcagggttgagggaattttactcataacttcaaacccaactagcaggctcaaaacaaaaatggctaaattcgtatataattcttgactcataatgactaatcccccttctcagctgacttgtcgtcagaatcggcaggggcagcatcgtcttcagccggttttgaaattggcaggttcagcgctttgcggactcgttcagaaataatttcgccatgatcggtggcaaccaactggctcatcacatcatcttttaaatcgatggtaatttgagcatccttatcggcaacatcattaatcactgcctgaacgttcttagagaacatttcagaagccgacgttgccatttcactggctaaattcccggccccaatcagttgaacaccggaatcagtgatcactgtttggtcgggctttgatccagcgacattaccacccaaatcactggcagccaaatcaacgaagacgctacctggtttagcgttatcaacggcggcttgaggaaccagcagtggcggctttcttccaggaacctgcgcggtggtgatgacaatatcattttgtttgataaacccaattaattcgtcttgctgctgcttttgctcatcagcagacaattgacgggcataaccgccttcaccgacagcactgactgaactagtgagaaattcggcaccgagtgattcaacttcgcctcgagacgctggacgaacatcataaccggaaacaattgcccccagccgtttggcagttccaatggcttgcaggccggcaactccggtccctaagaccaacactttggcaggcttggcagtccccgcagcagtgatcatcattgggaaataacgggcgaatttgtcagcagccaccaaagcagctttgtaaccggcaattgaggcttgtgaacttaagacatccatgctttgggcacgggaaatggtccgcggcagcagttcaaacgacagcgccgtgaccttctgtttagcaagtttttgcaccgagtccaaatcggtcaaggccttcaacaagccaattaaaatctgtccctcatgcaacttgcccaaagtctctgaatcaggtaaatcaaccgtcgcaatcacattagcctgactaactgcatcgtctcggctaacgacttttgcaccagcatcttggtaggcctggtcagaaaaataagcattctgaccagcgccctgttcgatcataacttcaaacttgctgtgaactaatttcgcagccacatccggtgtgattgccacacggttttcatcgccagattccttcaaagcagcaataatcgtagacattaaagcgacccccttcacaatcattttgcaaacgctttatacggttcaaggctagtcctcttcatcgagaattgcaatggtttgtgattaactttacaagcatagaaaaacgaaccaaaaagttattttcggttcgtccttaaaattgaacgtgggggtacttatcagcctgttgattgaacttctttgtttgaatagaacaaactcgcgtatcaatatctggcatcacacttaacaagacaggcttacctagcaagtccttagtcttaatcttttcatcatgggtagtgaacactttgaacttcggtaactggtcaccatcttgtaacggttcaccgactaagtctaacgcttgatcatgaaataatacttgcacgtaaaacaccccttcgataactaatggttttctaatatttgtggtagtaatagtacagctcaaatttaacgcaatttcagtttccgcacaaataatcgtctcaaaaattatcattcttgacatgcgacgcgttatttgacgttagtcatggtttaaacgtgcttattagttggtttgctgttcgtcagccgatgcgcatcctaacgtgccaacatgtgtgtacgccgatttcagtatattcaagcattaaaatgtggtgtcgtagccagctggagtgcaagttgggttgcacgttcgagcgaatcgtttgtttgttgttcccagcgggcagcgagtgtgttggccgggtcgtgcagactagttaaaatatgttgggcgacttgcaacgcgtgtggttgatgtaaactggtagccatagtttgtagcgcgtcagctagttgttcgccttcagttagctgtcgagtcacttgcataggggtttcgatggcaacttgttcgttggcgtgctgacccgcctgaatccaattatccgtactagctggcactggtaaccagagcatcagtaaaacgaaccacgttaagcaggtcagttgggacagatcgatgcccgcaccggcccatgggttcagatctaagttacgtaattccaagtattgaatcccatcctgacatagttgtgaatgaccaccagcatgacgcaaccgaacctgaccgtaaaattccttggtcgcacttaattttccattatcaacggccgcttgcagtgtttgacaatagtcatttaacgacgcgtacgagaccgtaacacccggccgattggtatacccgctagaactgttgcgtaagcttcgaacgggctgggctggtggcgtaagaccagactgtggccagcagcgtggtgagcagccataaagatacgtcagtagccagcgatagtgcaaataattctgcgcaatgtgcaggtaacagcgattttgaaaggtggtgaaatcacgactatctgtctgggcctgatacaatcccatcatcagactagccgctaagctcacattacagtgaacacctgacaacatttgacgtcggcggccatagcggtgagcaagtccttgtcgataggcgacagcggccgcatccaacttagcaattggaatatcccggtcttctcgtggaagtgtgggcggcatgcttagcggccaaatcagttcaggcagaagcctttgccggacttgttgtgtgagcatcgttaaggcgtgcaacgcagcaaccgcacttgcttgcggttgggtgactaactccaactgtgtctccgcaaagtcccgttgcaggccggacaactcgctgataagtgttggtgataatgccgtatccgccaaatgaccggtcaccgttacccgctggccttcccgttccagcccaatctgaacaacctgtgcattgatcaacgccgtattttccattaataattgttgccactccatccactcacctcgctgattcaatctaaatttatcgtagcatagtcccgaccttggttcactgattatgacctattatttagctgacttaccattacgaaatgagtttccgcgcgtccctgcttgatcatccaaaggatagaaactatccttcaacaccatttgacaaacttccgattttttgagtaagttaagtgacagcattgattgttatatgattgtgtatgtcctaaatggacacaagcaacgctcctaagcaaagcctgtatgtaagtgatgtacaggttaagttaaaaagggcgcatggtggatgccttggcactagaagccgatgaaggacgggactaacaccgatatgcttcggggagctgtacgtaagctttgatccggagatttccgaatggggaaacccagcagttttaatcgactgttactatatagtgaattcatagctgtatagaggtagacgtggggaactgaaacatctcagtacccacaggagcagaaagaaattttcgattccctcagtagcggcgagcgaacggggaacagcccaaaccaatgagcttgctcattggggttgtaggactgaacatttgagttaccaaagttgttgataatcgaacaatctgggaaggttggcgaaacagggtgatagccccgtaggtgaaatcaatgaccctcagttcaggatcctgagtacggcgacacacgtgaaacgtcgtcggaatccgggaggaccatctcccaaggctaaatactctctagtgaccgatagtgaaccagtaccgtgagggaaaggtgaaaagcaccccggaaggggagtgaaatagttcctgaaaccatgtgcctacaagcagttagagcccgttaatgggtgatagcgtgcctcttgtagaatgaaccggcgagttacggtaacatgccaggttaaggtttaaaagccggagccgcagcgaaagcgagtctgaaatgggcgttttagtatgttgctgtagacccgaaaccaggtgatctacccatgtccagggtgaaggtgcggtaaaacgcactggaggcccgaacccgtgtacgttgaaaagtgctgggatgaggtgtgggtagcggtgaaattccaaacgaacttggagatagctggttctctccgaaatagctttagggctagcctcggacgtagaatcatggaggtagagccactgtttggatgaggggcccgtcatgggttactaagttcagataaactccgaataccattgatttttatccgggagtcagacggtgagtgataagatccatcgtcaaaaggggaacagcccagaccaccagttaaggtccctaaatatatgctaagtggaaaaggatgtggagttgcatagacaactaggatgttggctcagaagcagccatcatttaaagagtgcgtaatagctcactagtcgagtgattccgcgccgaaaatttaccggggctaagcatattaccgagactgtggacttgacctttggtcaagtgataggagagcgttctaagggcaatgaagctagaccgtaaggactggtggagcgcttagaagtgagaatgccggtatgagtagcgaaagatcagtgagaatctgatccaccgaatgactaaggtttcctggggaaggctcgtcctcccagggttagtcgggacctaagccgaggccgaaaggcgtaggcgatggataacaggttgagattcctgtactagttgatgatgtttgagcgatggagggacgcaggaggctaagttgtgcatccagttggaaagggatgttcaagccacaagtcagtcaaagagtcaaatgctttttggcgggttgacaagtggtgatgaggaccgaaatttaagtagggaagcaaccaacgtcacactgccgagaaaagcttctagtgagtcatcaactacccgtaccgcaaaccgacacaggtagtcgaggagagaatcctcaggtgagcgagtgaactctcgttaaggaactcggcaaaatgaccccgtaacttcgggagaaggggtgctgtgcgcaagcacagccgcagtgaaaaggcccaggcgactgtttatcaaaaacacaggtttctgcaaaatcgtaagatgacgtataggggctgacgcctgcccggtgctggaaggttaagtggatgagttagcttcggcgaagcccaatggctgaaaataaaaaaagagtttcgattgggttgacggataaacagtatgaattagttcaaaaattggctaaagaaaaaggcttttcgaagtctgcaatatttgttttagctttagaagaatattcaagaaaggaatcagagcaaaaaaataagtgagaactcattcccttcaagaaatacgagttctcactaatgcttgttctgtcaaggcgattataacaaatggcaaaagaaaaggcgagatacttcacttttttactttatccagaatcgataccacaagattggcaaacaaagcttgaaactttaggcgttccaattgcaattagcccgcttcatgataaagatttgagcagtgttgaggggcaaaagtataaaaaagcccattatcacgttatttatatctctaaaaatcctgtcacagcagaaagcgttcgcttgaaaatcaagcgtgctttaggcgataagagtgttgctaaagtacaaattgttgtccagagcatggaaaatatgtatttgtatctgacacatgaatctaaagacgctattgctaaaaataagcacaagtacagcaagcatgacatttctttactgaacaattttgacattgatcgctatattacgcttgatgttgaagataaagacgatatgttgaatgatgtttgcgatttaattgacgatcataatttagcaaatatgcgtgaattaaggcgctttgttaaattacatgggattgaatatggcttgcctagtatgaaaattataaattcagtgttgagagctcatactggattgataagattatatttcgatgccgtttatcaggaacgcaagtatggcagaggtgatataaacaaagagactggtgagatacaagattaattaatgaatggaaagtaggtgctcaatttgagcacctactttgttgtcggctagccgacttctgatacaagtctttagcacaataacacaaccaactttagttgttgtgtgtaagtgcgcattgctttaaaaatggcaatgaaaaaatccaaagaaaatgtcaaatgcgcacttacactccaaatgaattggagttgtgctaaaacacttaaacctgtatcagatttcgctttgctcaaacaaaactgacttgcgtcagtttggaacattcaaaaataaataagttcagtcgctagctccttcggacttttttatttttgaacgttaattttaaattctcttatttgcgttttaagcgattttagctaacagtgagctatctaactgtctgtcaacggtaaatcgacttagaggggcttagagagccttacaggcgatattagcccctcttggaggctttaaggagttgatagactagacaataccaaaagcctgacgtcttggaaaaaaagcccttgttttcccgagcccagtggcggcgaacgatagcggtcaagctggctcagcttggtctgggtttggggcgacagcgcccaagggtttaaaaaagacgtttcagcgatttttgctgatccgtcttttttggtttgtgttgtaaataaatttttagcgctgaggggggcgagggagcgaattttgcgaccgtactacgaccccccttttaagtgccgagtgccaaaattgaatttttcgggaccttatccctactctcccaaggactacagcgattaaaaaaaaatcaacaaatcgccaacaaaattggcaaaaaaacgtgttgatgtaaaatagcttgacaaaaaaagcaaataaaagtaaaatttgtttacaatatttaagaggagaatattcgaacccaattcaacaacgcagggccaagaataattccaacaaataattgaccgatcactgctgggataccaaccctagaggctagatggccaaatagactagttgcaatcaagatgatcaccaaggtacctaaaaattccaaacaaaaacctcctcataccccggtttgtaaaattaagttagaaatttaaaaagccatttgtgatagacttttgagtgtcaaaatcaaaagaaaggctgatcacaaatgacctatactcatcttactatagacgaacttgccacaatttattctttttggaaactcggtaaaaaggcttatctagtggccccagcgctccatcggagtgctgaaactgtgtatcgtatttatcggtttcttgacgctggcggtacgattattgattaccaatgccactatcgaaagcataaacaacattgtgggcgtaaaccaattcaactacgccctgatgaactggcctatattcaagccaaaactcaagctggttggcaaccagataccattattaatcgccaagaacgggctttcagctgtggggttcgaaccctttaccgccttttcaaacgcggtgttttggggttgtcgaccaaagatttaccgatgcacggcaaacggcaccctaatggttacattgaacgccgtgggaaagcgggtcaattgggcagggatttaaagaatcgttatcaggactatcctaattttaatcaataattcggccatttagaaggtgacacggttcaaggtaaaaaccatcagggtgcggtaaccacgctggttgaacgacaaactaaggtcgcaattgtgctgaattcgcataccaagtcggcacacgatgtcaatcgtagtttagcaggatggctttcgaagctgccacgacacctatttaagtcaattacgtttgacaatggtaaggagttcgccggttggcgaaccattgctaaccaatttgatttaaatatttactttgccgctgtcggagcacccaatcaacgtggtttaaatgagaacaccaatggtctgctgcgtaaagatggtttacgtcacaatcttattatggaccagctatcagatggatttgttcaagcagttgccagtcgacgaaaccacatcccacgaaaaagtttgggttaccagacacctctggaagcattcatcagtcagattacagatgaacagttaaaaaatttctaacttaatttgacaattcgggttataataaattgattcaaactcattatgaacgttagaaatagggagtgtcaagaagtttgtgtaaaaagggattgccctttctccataaaattaaatcttttcagtcgaaaagtgattctaatgtatccttaacttgtccgaatccacgatgaattcgattaaagttcttttcgttgtaactaattacttgcactccaatgaaattgtctaatgatttttcattgggaaactgttcttttgctttagtcttgcgtttaatctttttatttagcgattctataatatttgttgaataaatggttgggcgtattgcggctggaaaagccaaaaaagctaataattccttttcaattgacctaatgtgactaatcagatttgtgtattgcttttcctggattgaagtcaatatttgagacagattttaagagacattcagaaccgcgtttaccttccacagccgttaacaacattatgcgtctcaagtaaatcaactgtataattactttcataaggtgcattggtttcattgactgtaacaaaccaataaactttagctcttttaggttgtctgtcgagaatagaatacatggtactacgcctaatttggtaatcacccttaattttagtcatatacactaagttagtcgtgaacaaaggtactgtattgtctgcgcttaatttagagagttgatcacgatagtcaagaagtgaaacatactcgctttctttctcataatgttctcttcgtttatttccaaagtaccaaagccacataatataaagaatgcccaacatgattgttaacgtaacataaccgccatgaataaacttaaccaaacttgaaattagaaagattaactcaataaaaccaaaaaacaaggcaattataagtgctgttaccttagccaggtgtttctttaagaattcatgcaaaagcacagtagtcataagcatggtaatagtgatcgctaaaccatacgcggcctccattttttgtgaactaccaaagaaccagactacactaattgttattatacatagtatccagttaacagttgcaatataaatttgattttttatattacttggatgtctaataaccattctaggtaaaaattttaagccaattgcttcatcgactaaagtgtaagaacccgtaatcaacgcttgagaggcaataattgcagcgagtgtggctagcaaaatgccaactaggcgccaagttccggggagcatttcataaaagggatttaagttcgataagttcctgtaagcagtatcacctgcatgtctaattatccaagcaccctgacctaagtaatttaaaaatagggtactatatactagtggccatgttacataaatattctgcttgccaacgtgacccatatcggaatataaagcctctgctcctgtggttgccaaaaagatacttccaagtataaagattcccactttgttaactggactgaatagtaccctaattgcataataaggagaaatagccttcaatatcattggataattgattagattaacgattccaaagacagccaaaaagccaaaccataaaatcatcactggtccaaaggatttcccaatcacacctgttccaaaacgttgaatcataaataatacgagtagaacaactgttgtgataatcaagacgttatgttgagaattactaaacgccacagggccaaggtgttgtttttttaatccctcaatggctgaagtcacagttactgcaggagttaatgttccatcggccaaaatggccgccccaccaatcaaggctggccaaattaaccattttgaattttttctaaccaatgcatataaagcaaaaattccgccctcacgcttattatcggcttgcattgcaatgacaacatacttcaacgttgtaatgatcattaatgtccaaaaaatcaacgagatcgatccaatcacgtaattgggagaaatatttcccattttaccggcgtcaccaatcaatgcattcataacatacaatggtgaagtgccaatatcaccgtacacaattcctaaagtaacaagtgcccccgcaaaagaaacacgttctagttgcttattcatatttgcttgccagtcatttctcggattttagtggagttagaagtttcaagtggtccgctctgctataccctagtggccgtaaagcgcttagtgagaattattaattgaatttattgtttcactgtatttaacacctaatgcttcttcatctggaaataaggtttctcgtgaatatcctagatgccttaattctttttggatcaaatctttataggtagctggaacaattattttttgaggttcgtattgctgagttatcatattttgaattgtagaaatagaagttgtttcaagaaagggctgaaacataaaataaccatgttgtgctttaattcggggattgatttgggaagcagttacaaaaaagcactctgtaaataattttgtaaagtcaattggctttacataagctttgcaactatctgctttcaaaatctctaataatcggcaaacttgtggactattatttaactgcatatatttcggataaattagtttgtaagcctggtaataatgtgtgggaacagaatttaaactatttacttgatcctcgcattttagttcttgttctaattcttccaacgtttcagcttctgtatttccaaataaggtttcgtatatttcgtaaagtacccggcaccgatcatctaaaggaagagaattttcatcagaaaaaattagttctgtgaatttttgggattcgttataaatatattttttatcagcaggtttcatataagctaaagcaacttcgaagtctaaagaagtattttctaattggtcgtcacgttgtgtttcttgggggacaatgcctttttcttgataatcagcgggtactaagaaattgggaaaacagtaaataactccgggatcagacgaatcactacacgtggcaaaatataaggccacaaaaagacaagacgtaacgtctaacaatcttgtatgcaaaccgtagtgttgcatacatatcagtttctgaagattagaggtaattccctgtgagtaaatgttacttgggaatttttttatatgatctagttcattgtcttcatcattgtttctaagcaaactggctatattgtttctattttcatagtctttgctttgtcccctaaagtacaatctggccgcatttccttgaccgtcaatgaaagcactatatctgttcgaattacgatacacagcaagtagttcctttaatacttgatctacttgtttaacagacttaatttccaaaactaatccccccaataacattagcaaaatcaatcgaacattctatgttatcagcataacctcagttaagatgaagtacactactgatttaaaaatatgtttctaaaagaattatatctctgtataatggttccttgtagagaagttaaggcggtggctatttccaatcggaggtggtgcttatggtgttaaaactttaaagcccataaatcctaacgaaaggagtagcctaagtgtccgtttcggacgctttacaattaatgctggcttttggtacgtttatcgtagccttaatcgcattaattgttgagctgatcaaaagtcagcaaaaaaaataatccgtcttagcttttggcagggctaacggattatttaatctattattaaactttgccaccaagcatcatcaaaataataccaatagttattaatttttttctgaccagttaccttagtattattttcataataataaacatttgcatcttggtgaataaaaccattgtttgcagtctgataaactactaacccatcatagtcaattgaagaatctaaatagccatcataacctgacagttctgtttgagaactgtcttgccatgcaccataatcggtgttttttaaattgctagctgatggagtgtatggatattgagctaaccaaatattttgtttaccaactgcagcaatcacttgagctaaatactggtaattaaggtaagtataagccgcgtgatcagtatatccagcagcatttaaaacattaaagaagttcaataaattatctttgacatcatcggaggatgttcctacatcctccatatcggcaaatatccgggttgttttggctaaatttaaggtatttaatttctgtaaaagataattagcttcttgtttagctgaatctgttgaattaaaagtagcataatgataaaccataatattaagtccggcattttgcgcgtaattaatttcttgactagcgtacggattggtataattattcccctgggttactttgacaataactgttttaacacccttagcttttagttcattaaagttagcttgtgtcatcccatcttgataggaagaaacatcaactgcatctacacgaggtcgactagcatcaccaattttccaagaatctacctgagtatctgctgcagcaagaacttttttattcgctacggctgaattattttgatcttttgtcgaaagggctgtgctagcgacacttgaactattttcagctaccacattattttcgttacttgaactattgtttgttacggtttcacttgaagatactgctgaagaacttgagctcgaaacttgactgctactttgcgaatttgcactagtttgctgcgcatcttgtgatgttttagaatcactaactgattctgccttagatgcatttgaagaagctgtactatctgttgatttgttggtatcttcttcatcagtagcagagtttgctgattgagcagcactcttcgtatcactggcactgcttactgcagtagctgctgattgagcagcactcttcgtatcactggcactgcttgctacagtagctgctgattgagcagcactcttcgtatcactgctactacttgctacagtagctgctgatgaaacagcgctcttcgtatcactagtgctgttaacagtggcggcagttaagttccctgaggtggtatcagcatgaactgttaccgttgataccccaccgaagacaaaaaaagacagtgtagcaattgcggcaaaaacgaattttttgccatctttatacattttataatgtaatttcttttctcccattataaacttccttcccgctcaattatattgagctaacctatttttaattatatacttgtaaaataaaaataacatgcctaattctgcaaaataaagcacttggcaaattctataattaatccgaacagaaattaaaaaagcccaaagcaatcacttacaatggtagtattagttttcaaaacacactaaaaagactcggaatgaaaatttcgggtcttttttatgcttttaaatggtgaaaacgttgaaaatgtggtgttatgcccgatattgagaacataagcatttacaattctagtcgtatacggtaaactagtatccgtatgcaatacaaattgtaaaaccacttttttattgtcggagggaaaataatgactgcaaaatgggaaaaaaagagtgctagtaatggcgaattaactttcgaaattagcaccgataaaattcaagaaggtttagataaagccttccaaaagactcggaaacaattaaatgtacctggattccgaaaaggacgtgtcccacgccaaatttttaatcaaatgtatggtgaagaagcactctatgaggatgctttgaacattgtgcttccagaagcttatgaagctgctattgaagaaacaaaaatcgaaccagtagaccaacctaaaatcgatgttgatagcatggaaaaaggcaaggcatgggttttgaaggctgttgtgacagttaaaccagacgttaaactaggtgattacaaaggcctaaccgttgctaaacaaggtcatcgtgtaacttctaaagaagttgacgctgagattgaaaagaaacgtgagcaacaagcagaacttgttttaaaagagggcaaacctgctgaaaatggtgatacagttacaattgactttgaaggaaaagttgatggtaaggcatttgatggtggtaaagctgaaaactatgacttggaacttggttctaattcatttattcccggctttgaagaacagttagttggccacaatactgatgataaagtagacgttaaggtaactttccctgacgattacaatgctgaagatcttcaaggtaaagaagctgtatttgctgttacaattcatgaaattaaaacaaaagaattacctgaattagacaatgagtttgctaaagatgttgatgaggaagttgattctttagatgaattaaaggctaagactcatgatgagttgaagaaacaaaaagatgatgctgctgcccaagctaaggaagacgaagcaattcaaaaagctgttgataatgccgaagtcaaagaagttcctcaagcaatgatcgatgaagacgttcaacgtcaactcgaccaatacttggcaaacatgcaacaacaaggaattgatcctaagacttactacaagatcactggtacttctgaagatgatttgaagaaacaattggcagatggtgctgaaaaccgagttaaaactaacttagttttggaagctatcgttgaagctgaaaaaattgttcctactgatgatgaagttgcttctgaaatcaaagacttggcttcacaatatggtatggaagaaagtgctgttcagaaggctctttctgaagacatgttgaagcatgatatcgctgtaaagaaggctgttgctgtcattactgattctgctgtagaagaaagtaaagcaaaagctgctaaaaaagacgatacagcaaaagatgctaaatagttcaaatcaaattttgaatttaaaaagaatccattgagttccttgatggattcttttaatgtaagatcaaaaccagttcatgcaaagggttttactgataggtccacatcagccccagtggcatagttttcgccttgatagtgaacgatatcacctctactagaaaggagctatatgtgactctgtattctgatggagggatgtctgaagaaaccatgcgtggccgaagtgtaatgattaatggatctaccctcggagagggggcttgttttttcatcaccggatgggcagtacggttcttgcaccgttcacacgctcatggccgggtacgcttcaatcagacgcacacagatggagtagagtcggttggaagagactagaagtacttccacactggcaactcaggttatatgcttcgaaccccctttaccggtgaggtttaatcagccattacacaatcaaaagtggagtttgactcttaggagttaaggggcgtggaaaacacgcttttccatagtccatgccttcttatggcttagataacaaccagattggccttatctacctagtgctactataatggcccatgggcgtcgttatattgcagtgtagatgcttagatataccaatgcgtagtcttcccccagtaacttccagtgggcggcccagtaaaactcacaaattctgcatgctccactgggggaaaccagccgccccgcgcgccccggatatcacccttcctgggccattctaggctagtacggcgccaaaattttcgtgcccaagggcacgttaggatggtaagaatcttaccctttctcgcgaaagggaaagagaaaattactgaatgcggtaactatatcgcactatggtccagtagtgatattatctatatatctacagggcgggaaaaccgcttcgctttttgaaaatcgtaccctttttggatgtttcgcttttttcgcttttccgccaccgacgccactggggcacccagttgggccactggggctggcactggcacccactaatggaccctctgatatcacagatgtgatatcaccacgcacaatgcccatgagccacccactgggggagatgtgccccatggaacagcgcacatgccttgtagacaccaccggacagtgcacagcgtacagatacaacaaaataccagtcacgggggcccacgacaagccaccatgccagctgcacagcctggatcgaataatgggtgaaaacacgctgtttggggccgctggaagggtgaatgacgcgttatgagataacctccaatgtgaaggctttttatacgtgtttgtaaggtacaactcatcttcatagggtgcagccattatctaatacagtggttagaatcagtacagcccggagacagtgatacaacctcaacagtgtacgtaatatgcaacagtgaagcgttgaagtcatcaactccacaagatggtttgagttgagtattacaagtgtttgaaggttagatggtccagtcttgtagcaggcgaggcctctgaatacgatacactataatatgatgtaatggatgatcacaattatgtgttcctaaccgttaccatcgctgtgtgttagggtgttgtggtttctccatgttgggcgtgtaagaaaaatgacaactcttcgaatattgttacttcaaattaaaatcaaaaatgattaccttaaaaattgaggttttttaattaaaataatattattttatgctgtgttatccgcaattctaaatctggatcatagtgatatttgatagctttgtagcagtatgtaaataaaattattattctgataaaagcaagcaacgattgacaattctgatcgttatttttcgaatcatggcgtttttatattacaatgatcctagaaaaagtaaagttatggaggcgattagatgagtgatttggatcagacaaacagctatcgatacgtcattgttggtggcggagtggttgctggctatgccatcaagggaattcgacaggaagattcagagggtgagatcttaattatttcgcaagaggcggatgtcccatatgaacgaccggcactgagtaaaaaactatggctagatgatgaatttactgaagagaacattcagattggtgctgaaaattatcccaatgtgacttttaagttcaagacaacggttacggctattaatcggcaagataaggtcattacattggccgatagtgggcaaatcaagtatgaacagctattgctagcaactggcggagaacctagacaaatccagggaccttctgatccacatgtgctagtctttagacagtggtcagattatcgcaagttacgtaaatttagtggtccgaacaagcgagttgtgatcgttggtggtggatatgttggtacagagctcgcatcgtcactgacccaaaatgagactgaagttacaatgatttttccagaaaaagcgctgggtgagggtaaatttcctgagtctattcggactgagtatgaagccacgttcaaacgcaatggtgtcacactgatgagtggtcagtttgtccaatcatatcaacgccaaggtgaccacttgactctattgacaaaggatggtacggtgatcgcagccgatacgatcattgttgggttaggcgttacgccgcggattagtttagctgaagacagttgtttggatttagctgatggtggtgtgaaagttaatgagtatctcaatactagtgacccagccatctggtctgctggagatattgcctcttatccagatcacatcttgggtcggcaacggattgagcacgtggaccatgcccgaatttctggtgaattagttggccgtaatatggcaggtgctcacatgagctatcagcataccccatacttctattccatgatttttgatatttcctggcaagcaatcggtaatattgatcctaaattgcaattgatttttgatcggcgaacgcatggatcgcttgtctatttcatagataccgataagttagttggtgttttagtttggaatgttaaggtgaatcttgatgatgttcgcgcattgcttgcgaacgctccagctacagatgatctggtgggctccattcgagagaagaaggcttagtatctggatgagatatcggtgaatcattgcgtcatcacgaatgtactttagaacaaaatgtggttctacaatatttggtactgataggtgttcacttcgtgaacatatattggtaacatttttatatacagacaaaaaaagagaagatagcctgcacctatcttttccagaaaggaactatctctcatggatgattctatcaaagatgcacttggaattacagacacaagagttacttttgatgaaaaatttaaacaaacgcacagtgaggagatcactccaaagggagtggcatacgtctggaatttgaaactttcttatcccatgaactgccctaactgtaaaaaaaggatgaactacaatggtactaaaaccgttatccatcaagccatacccactggtactaagctaaacttttttagaattcgtaagcaaaaatatctttgtaaatactgtggcaacactgaaattgccatgctaaaagatgttaataaacgtgaacatatttttaaagctgttaaacaaaaggctgctttagatatagcagaggatgcaagtttcaagctaatcgctaaggaaaacaatatatctgcaaatacggtaaccagaaccgctttaagtttaggagcttatctcaaacctaattacaaatttttgcctaatcacattgcttttgacgattttaaatctggtaaattctccaaaagtggtatgagtattttgttagttaacattagtaaccacagaaccattgatgtaatagctgacagaggtggtaaaagccttgaaaaatactttcttagatattctagaaaagcccgcgaagcggtcatgacagttactgttgacttattttcaccgtaccggccaatcatagctaacgtctttccaaatgcaattatcctagctgatcattttcatgtagtcgtgcaggcttacacggccctgcaacaggtacgtattcgcataatgaaaggtttcaaaaaagattcacgagaacatcgacaactatcaaaattttggaagttaatagttaaacgtaatacagatttaaataggtcaaatcgttatcggcgacgaaatttcagaggagccatgttaacctcagaagaaattgttcaaagacttttacaactttctccagaacttcgttctgcatacaacttttatcaagatattttgttcgtgattcaaaatcaagatgctcaactcctaaaacaaaaaatatggccagataaagatgatcctcagtatgaagcatttccaaaagaaatgaaccgtgccaagctcactctgagaagacattatcaggaaatatctaatagtttcatcaaagattataagggttatacaaatggtcccgttgaaggatgtaacaataaaatcaaagtaataaaacgaacagcatacggcttcagaaactttaccaatttcagacttaggatacttgtagcattttctactagtttctactctataaattataaaaacagtttaaaacagctaaacaaaaaaacaactaatcctcctgaaagagaactagttgcctagtaaggactacgtccttgaattaagtcatcagtacttcttgacgaagagccgccctgccaaaagctaagacggattatttttttgctgacttttgatcagctcaacaattaatgcaatcaaggccacgataaatgtaccgaaagctagcattaattgtaaagcgtccgaaacggacacttaggctactcctttcgttaggatttatgggctttaaaggtttaacaccataagcaccgcctccgatcggaaatagccaccgccttaacttctctacttgattcattatacagagatataattcttttagaaacatatttttaaatcagtagtgtacttcattctaacctggattagtgtattaacgtaagtcatcttagtaagaacattgagcataaaaatacggtaattgattcattttatcagagtgcttgcttatatctataggaggttctattttgaatattcaatctgtaaatagttttttaagcaaaaaagcagaatccctaaagtctataaaagctaatgtaacagttgatggaagaggtttgctaccacgatttttctatagaggacagtcaaatgacttcaaaagtagtaataacgttgctagcatctttagacaaaaagagctctccggatatacccatgaatattcatttactaatgagtacatgcgtaggtacgcaaacgattttaacaatttagaaaacaatttttctcgcctgtcttatatgcaacattttggcttgccaactaggttattagatgtaacgaccaatgctcttgtcgctctttattttgcctgtcaatctcatcttgattctgaaggacatgaaacagacgggatagttaccatgtttttttctaacaagacacaaaatattgatgatttcacatactatagtagtcgcagtgacaccgtggaagtcttatcaacattagcattgatggacgaagaaaaaaagaaaagtatttatagaaaaatatcttctttcaacaaaaatattgatgatttgttgaaagaagatgaaaatcatttataccaaagttggtacatggatctggtcaagcagttcccagagggctattatgaacaactttctgaggaaaaccaaaaagtatatgactcactaaatgatttctataaagaaataaatcagtcttatgaaatgcaatgcctgtatcatgatattaaaagagatactggttattttgctgatctaatcaactttagaactttacttcacccatttttcgtcgaaccttcaattaataatgaacgcttacgagctcaaagtggttttttcctttttgaaccttatgatggtacatcatgtagcttggaaaatattcatgatgatattgataacaaagtatctctgtacaatggacacaatgagccaattagattagtaattcctggtgaaaaaaagcaacaaattttaaacgaattaaatcaatcattggaaataaaccaggctactttatttccagacaaagaaaatgtggctagttatataaaaaataatttttaataaaaaatgtttaaaggccattagggcataccctaatggtcaatgatgtaagaacacaaaagtaagatatgaagtcaacagcccatattggctgcagccatattatgacttcatatttcaacattagtgcctatagtttacataaaaggagacaaatttctttagagccaacacctgaccaagatccagttaccggtctttgtgaagaattgctaaaaactaacgaatcaatgctctacattcacaatgttcttcacaatattttcagtgaccatttcagaagcaaaaacacagaatttggaagtatggttaataacccatctaagatgaatgttgaagatgatggttatttgaatggtgaatcttattttcaagggtaatttgatcatctcatcagaggatattgaaagtcaaaacagagtcgacgagcaaaacctattccttgatcagcttgattttgacattgagacgcctgagacgtgtattgcgtcaagaacatgaaacaaggaacaccaacaacaatcaccatctgaatcaccatcgggatcggaattagaggaagaatcagatcttctagatgttattgagcaagaagaaggagaaggagaacgagtagagagagtcgtagacgatgaagcagctcttctttctaacaccaatccagcgagctgctgataccactttaaatgcaactgtgaatagaggaagtagcagaatctctttacgtgaaccagttcagaggatgactacaggacaatcactagagcaaggatgctggcttcgagtccattacaaactttaggtgctgatcaactaattactgatattgcatcttgagaatacgttacgtaatcaaaataacaataatgaagaagagtatccgagaattatgcgcttcagtcgggggctttttcgcgctttcctcatagtaactggctttaagtagatctttttcgcccattttgtatgctgaatacgaataaccttttactcaaaccatttcttgactaaagctgtccatcgaattgttcgccttggactgaactttataatcctgcttgccgcttttaccgagcttcaaaactgcgaaagttaatagggcctaagtaaccagcactgaaacatcttttttggtcattttattctttgattacaaagtactgttgaattgagactatccttgtattgatatccattgaaaaagatgtttgttctgtgttaaaagaaactaaataaaataagtatataggaaattctacaataaagggaaggaacaggagagcccatagaaggtggggacacctgtttatataataaatctgagaaaggaaaatgaacaccgttcggcgtagtggaggccgtaattccggttcggtgtagtggaagccgcaattccggttcggcgtagcggaagccgtgatgccggtccggtgtacggaaacccgacaccaaccacacatgaatgtttggtttaaccgtcatacgtcaacaccctaccataaaccaaacattcaaatgatctgaacaccaatgagactagtgaaacctttgaacttgagtctaattagtttctcaccttgttctttgagcactcagattcctgtaccaaaccatcctataaccaacgatagtaacaataaagagtaagattgtaaatggtacttaaataaggctttgtgatcttgttcgtttggtagtaggaaagcttgtttttcaataggctgctcatgccaaataggttgttgtttccaaaaatgatatagctgttggggaagtgctatcgtgggtggaatagcaatcataaagccaatgattgctggtcggatttggatgatactatttccgaaagcaactatgtaccagagccacatgagcgaaccataaaagcaacctctaacaactgtaaactctagccagaagagtagttcgttttttagggagcttctacgatacgtttgaaggacttttttcttgatctgtttcatcttttgacgggaatcgcttttttttagaaagaggccccaaaaatataactcgtctgatcttgtatagtccataattttttttcgaatcttaccaagaaatatgagtaaaacaaactcaactaataagatcaataatggtaacatcaattttgggcctccttaaaaaggtacacttatccagtcgctggtagttacttatcgtgaatgttagagttatactattgctgattttaaccaccgaaattttaatagttaattcagtgggcgccaacgtggtatttattaatttgggccacaatagccgactacatctataaatgacatggtatcatactatttatagatgtaggttgctaatgaatcttttaatcgatggttatgttggtttttctcaaacagtccaactttaaccatgtaacaattaatgagatcatagcagcacttgaacctattaatcaacggccattgaaaactatcggacttattcggattaattttacaatctgcctattgaaaaaaaaatattcaaaaaattattcattctttccaaccttcactttacttagtgaattatcaggtgttttactgtaaactattaatttctccattaaatcaatgtataatgtgtagctatttgttattttctttaattttttcatgtaaaaacttatgacgatcagaaattaggctaagaaactttgcgaggtcatcatcggtaggtagttgcttaataaagttacgtgctactgaccgcttgttaatatattgtttttatcgtcctattttttattggcccgtatttgagattcagttaatttagacatgatattttctcattacttatttaagttagatacatattatatgtacgaaggcatttcatttacacaagattcttgacgctacctcgtactcatacggatcagcaaacatcgctaacgttgttcttaaaactaagtcatagacttgatgctgtattttaggtaaggtagctaattgatctttagtcgggacgactttagtcataataatggcatagtgttcttcaaccttttttccattaacatagcgcttatttgggtaaagtgaacccccaaggttggacagaaaaatccaattttgggggtttcatttatgagtaaatttaatttcgattttaaagttaagattgtcaccgagtatttaagtggtcaggcagcttattcactagcgagaaagtatgggattggcagcaaggctaccgtttcaatttggattcagcgatttgaaagatttggtattaaagggcttcagccaaaagccatggacttagaatacactagtcagtttaaagttgatgtattaaactggaggaaacaaaatcaggcctcacttccagtaaccgccttacactttaatttatcctcgccaagtacaatttggcaatgggaaaagcgatttgagacattagggataaaagggcttgagcgaaagcgaggcaactcgaaaaatatggcaaaacacaagaatgagaacgctaaaccagttgtccaaaaggacaactcaacaacaaaagatactttaaagcaactccaaaaagagaatcaaatgttgaagattgagaatgaatacttaaaaaaattagaagccttagctcggaaaaaatcagcacaaaggaaatctcgaaaatagcgactgagttgaggcaaatattccaagtatcaattaaattgattctcaaagtaattaaaataccgcgtagcacgtattactacactcgaaatcatgaaggtcgaaaattcaatgacgatcaagttattcaagcaattgatgaaattcgacaacaagatttaaaatacacaaagaagtacgggtaccgtcgaattacaagtgctctgcatgatttaggatttcagataaatcacaagcgggttttacgtattatgcaagaacatgcctggatatgtcatgcctttaatcgccaaactcgtaaatataactcgtataaaggattagttggtaggattgcccctaatcggttaaagcgtcgctttaagaccgacagaccctatcaaaaacttgtagcagacgtcagtgaatttcgatatggatctatgggaacaaatgaacgcgtttatttggaaccggtactagatttattctctggagaaattttagcatttaatataagtgaacatccaacagttgaattcgccattaaaccgctcaaagaagctttagaaggacttccggcactaaattatcggacaacagttcatactgaccaaggctttcagtatcaacatcgccaatggcgaacgctcttgaaagaacatcatgcattccaaagtatgtctcgtaaagcgacttgccttgataatgcagtaatggagtcattctttcatattatgaaagcagaaatgatggatgaacattttgaagataaaactagcctaattcaagcaatgaaagattggatagacttctataacaaccgtcgtatcaaaacaaaattaaacggcaagcccccggtaaaataccgagaactcgccgttcaaaaagcagcttaacaatttgtccaattttaagggttcacttcagaacacattatctgatgttatcttagttacaacgcatctcattagcgtataactattgctgtcttcgccattaccattgacattgccatatttcaatgaatcagtgcctccactaatatcattctgaatacctttcaatatctcaaatctgttgagcttgttcataatttcaatatacccctcactctgcgagatacatttacgataatgttcatccgtgaccgtctgtagtctttgtggattccacctgtcgtctcgctcatccgtcatttgaaagcaatggattgccagatatctgaataattgccactgattcaaatgactctcaatatagttcaatgaggtaaatgacgcaaaatgacctaaaccaagtggcaaatacccactcttttcacgagattcaggtaagtccatctccaacctcaaatccaaatggccaagaaatgctaaacatcccacaaaggcagtcaagtcacctggagttgagctcaattgaaacccaaatgtctcgtaagagttagcataccatctgaaaattttgaatttgcggaaaaccttataatcttttgagtttggtatagccttttgcaaatttctgctcattactttaatacccttctcagcacaaaatctagcgaggttctcgtcaatcaataatttcaaactctgaataatccactgtcgatcacgatagacacccatgctctcatcactatcactatcatcatcactacagatatcgtcttggctgttgttcatttcctcagctaatggagatggtgacatcgagtctgtacgattatgatactttgcgatgagctcttcattggtgttgccactttgattatcgataaagaactgcttgaaaagttcaatgtccttagtagtatctgaaccggttctgaaagttttcaaataccctaatcttatccgtgatttctccttctcaatgagtaagttgaacaacttattcaatgctaaccaacaatccatttttgatttggagccttggagattgatagggtttctgttcttgaaccaatcatcgtcaactttttcgactttcctgaaaacatcgagtcccactttaatcactggagcaactaacgattgtgaatcaatcaggttgtggttgaacgtcaacttcatacaaggctgattcactcttaggccatgcaaaaacctatccaatttggggaaactttctatattcccaccaactctgatcggttcttgaactgtgatattttcattcggtgcctgattaggaatgggaacaaaaatattgaatctatatttggttagtgagacctgatcaaccgagaaggcgatgttatcatcaatcttgtatacttttctaacatgtcccctttcaacatgttcccatattttgccctttgtgttttgtataattttaatgaaatcgttagagaaattcttattctcgaatcgtctactgatagcgagctctagagctctttttgtatgaactcgaaaagcgaacagcactcttagccggaatctgaagaagtttcggtaaccaaatccagtgcgtttaatgactttaatcttgttgtttgaaccttctaagggcccgttggtgtaatggtgagtaaaggtattgccaatttcatcatgatgagtcgctagggtctggagggttgccaacatctcttccgagcagccctctaagtgatggaatacttgattatagttgggccaatcacggtttttgatggtttcacgtaaccgattcatcacgttgtaagtttgcttgagctcgggatcaatgtccaataaagcatcaaccacatcagtggcagtcgctggataagggaagtttgtccacttacggaaagcttcgtagttgaggtgattttccggcgttaataatagtttccaatagcgttttagggcgtgatactcgcgtgaggaagtcgccagggttttcatgaggcgcacccgcgtcttattaaaagctcgatttaaagcgttaaccaagtggaacggatcgatgacaacgatggcgttcggaaagatctgccccaccaatttgggataggtatagttcatatcggtgacgataattttcacattttctcgcgcagcctggtcgtaatgctggaaatacttttgaagctgatagatggtcctaaagggtaacaggtcgatcaattcgtgggtttccgcatccataaattcaaagctcatcgcgtcggtggcgctcttagtgcttttaacttcgtccatgaggagaacttttggtaaatagtgccagttggtttgaaagtcccgttcagcgcgcaagagctgccgaccaacgaatgaatccgaagtggataactcatcggcaatgtgtttgagcgaaaccggttcggtcagtttttctaagcattgtttgcgggtcgtatttgaaatcgtgcagtgtttcggcaccgcattcgtctgcgccaggaaattggtatgacaagccttacagtgaaagtttcgccgattgagacacaggataacggtgctgcccaatgtttttgcgaatctaatggtggtcttccgccaaccatagccaataatttggtgatcattgataatcccacaattgcggcatgccttgggggtgtagtttagggaccccaccaatcgaatcactccatcatcacccacttgtccttcctcaattattaagtgttcatcatctattcctaacaacattttcgtagtatcatttgacatagggcatttcctttcttgacttaattctgtggtgggagcaagttaacggacgggagatgtccgcttttttattctaatgataaacaaaaaatctgtcatcagtaatagataaaaatctattaccaacaacagatattgtagaaccttttatcgaaggcaccaaaggaactgccgccttgtggccttaaggccctatttatttctctgtacatttaatttaccatctattactaacactgtcaacgcaggcggcttttaacgctttatatgatggggcgccaatatcctgcagtattctggaatttaaatcataactatttttcgagaagtttttattgttttggtatatcaaactcttgaaaatctttcccaaaggccttaaatcaacaaacattcctaggacttttaaagaatcgaacaattttagccttgacggaaagacgctattaccgcctttgtgatagggatcgagtgataatttagtcactaaattacggttgagcttaatatattctggtgttgaaaatctttcaataaggaagccatgtgcacacttatttcgaagctccttgattacgtcaagtgcacttaaaaacgcaaatctcgagctcggtttgaagttaaaatcacttagaataccggtcatatcagccggttttaaatagtgagtcatttttattaatgtgccgaaatcgagtgtttgcactgtaacccatagagggacggcaacttggttattcttatgatagggggtaactcctggtggttgcacatagtttggatcttgataaaatttgggatctataaagtcattgtttcggattaatttatcaatgaagtttggcttaaatagttcaaacttgtcaaaattttcatacgtatatttgtattgataacgagtaaagggatactgatagtcattcttgatgttgtaataattgttcttattggtgtattgcattgtatcattcagagttcggcaatgatttgcgctgaaattatgtgcaagggatgtttttagctgatcttcaaaatcttcaatcaggataaatattgcactttcaagttgcttattgaatttgtataaacgtttaaaatcatcaaaagtttccgtacgaaaacgtttcgggaccttttgagataagagatcattttctaatccattgatcagttgaaaataattcatcttttttaatgtggattcaatctcttcaacattagtattttgtaggagtcgttcatcaatcagtgttttggcaagctcatatcggcttttccaaggctttatagtcatttgatgtccctctgtcttattctgcctctcggttctttcagttaaaattgtggttatctctggatcttcatattattttatcttaaagatcggcagttggctacttaaaatgggataaattcgatttagtgggtcaaaaaattgaccgctgttaacacgttatttgaaagtcgtgaaccccaactgtctttaactgtaaatgtgcccattttctggggttttagggggactttacgtatgatagggctctttttgtatgaactcgaaaagcgaacagcactcttagccggaatctgaagaagtttcggtaaccaaatccagtgcgcttaatgactttaatcttgttgtttgaaccttctaatggcccgttggtgtagtggtgggtgaaagtgttgccaatttcatcatgatgagccgccaaggtttggagggctgccaacatctcttccgagcacccctgcaggtggtgaaaggcttgattatagttgggccagtcgcggtttttgatggtttcacgtaaccgattcatcacgtcgtaagtttgcttgagctcgggatcaatgtccagtaaagcatcaaccacatccgtggcagttgccggataagggaagtttgtccacttacggaaagcctcgtagttaaggtgattggccggcgttaataatagtttccaatagcgtttcaaggcgtgatactggcgtgaggaagtggccagggttttcatgagacgcactcgcgtcttattaaaagcccggtttaaagcgttaaccaggtggaagggatcgatgacaacgatggcgttcgggaagatctgcccaaccaatttgggataggtatagttcatatcggtaacgataattttcacattttctcgcgcggcttggtcataatgttggaagtacttttgaagctgatagatggttctaaagggcaacaggtcaatcaattcgtgggtttccgcgtccataaattcaaagctcatcgcgtcggtggcgctcttagtacttttaacttcgtccatgaggagaactttgggtaagtagtgccagttggtttgaaagtcgtgttcagcgcgcaagagctgccgaccaacgaatgaatccgaagtggacaattcattggcaatgtgtttgaggctcactggttccgttaacttctctaaacattgtttccgggttgtatttgaaatcgtgcagtgcttcggcactgcactcgtctgcgccaggaagttggtatgacaagccttacagtgaaagtttcgccgattgaggcataggataaccgtgctgcccaatgttttagcgaatctaatggtggtcttccgccaaccatagccaatgatctggtgatcattaataaccccacaattgcggcaggccttgggagaatagttcagtgatccatttaatctgattaccccatcatcacctattttgccattctcaatttttaagtgttcatcatctattcctaacaacattttcgtagtatcatttgacatagggcatttccttctttctctaaaatcttcgtggttgttggttttgatgaacggacaggaaatgtccgctttttttattctaatgaaaaacaaaaaatcaaaaaatccttgtcgtagagcacgccgtgattaacagtttggattttatagactatttatgtgaacactacgaagtgtactttatacccaagcccaaaagtattgatcgtaaagtccttaaacatttatcaaagacttgtacaatattagatgtttctaggaaagaattagcaggcgttgatacacctaacttgataaaggaaattgtcggacaggacacgtttgcaattattgatattagtgggtattttgtaccaagattaagtgacattcagaaacagtttaaaggtcaattggttaaaataatcgaggatacggaaaatggctaccaaaagtatgaagataagctgtccaataattcaatatcagtcccaatactatcagtggcaagaagttctttaaaaattgaggaagattttttggttggacatgagattgtagtcaaatccgaaatctttttagcagattatggaacgacgcttttaggcaagaaagtactagttattggctatggtaaagttggctccagtatagcgggtaatttaagaaaacgtggtgcaatagtcatagttgctgataaaagggcaatacgattagctaacgcattagcccatgggtaccaaataactaatgatatatatactgagctaattgacgttgatattgtgtatatagctaatggagagaagtctattgatactcttcaactaaaaaaattggatttgaaacatactttatatagcttttctgtaacttcagcggacgatacttttaaaaatagtcaaatgatcaacaaattaccccactatggacacaatggtgggtataaaattttaaaaactaaaagcaataggactgttattctagcaaattcagggaacgcaattaatttcacatactctatatcaacattagcttcctacgtccaattaacacaggctgaaatggcagttatactacaaaaagacatttcaggtgaagaaaatcagggaattgttgaattaaatgaaaacgacagagaaaaaattgctaaagaatggttggcagagatatttgaagttgttaaaagttgaattaaataaaaaagcttaaagaattatacaaataagctctggttgctaccgacaaagagattttaagctgtttttagttgctgctaaactttgatcgtagtattaaacaaaaataccttattaagcgcaactttcactgaaacagttgataacaatattaagatgaaatttggtttcctcgtcaaagtttctgtataatagattaagcaggaagttttaagggcggtggctgtcttttcccggccggcaattaaactactgtttttgaaccaagtcatttaatactggttagtgaagtaattttgatactttcaacctttagtgggttaagtgttactctgcatcttgccagacttttttagcggtgtcgatgactaaacttaattttgcccattgttgatcagcagttaatttattgccttcttcagttgaagcaaaaccacactgagtagaaagcgccaagttttctagtgggacttcttcagtagcttctttgatacgtgtgattaattgagtttggtcctctagctctggaaatttagaagtcacaagacctaagacaatccgcttgtttgcatcatggttccagattttagcgaggggcttaaagtcaccggcacgatcgttatcatattccaagaaaaagccatcgtagttcaactgactaagatagtcagccacaacatcataaccacctgaaaataggaaggttgatttgaagtttcctcgacaaatatgtgtcgttacggtcaaatcggtgggtaagttttccaagagtttattgataacataaacggaatcttcagcaattttacggaatggcttttgagcttctggatcgtttttagtttcgtccagcttgctgattaaaaatgcccaagttgtgtcatctaattgaatgtaacgacaaccaagttcgtaaaagtgctgaattgtctcgtggtaagcttgcgccaaatcatttaagtaatctgtgtgatgctcataaaacttaggggcattatcactgcgattatcacggaatagtaaacttggtgacggaatggtttgcttagcttggacaccatcaggaacgattgagtttaaatatttgaaagctttaaaaaagggatggtctggattgtaactgatcttgctggttaaaaaggcattgtcagttcgtgttttttgaccatggaacttgtaactcttttggtagtcgtatttgccaacaccatttaatccccaaagaaaatcgagatgccaccaagagcggctaaattcaccatcagttacggcatggaggccaagtgcaacctgtttagctacaatttttttaatttcttgttgttgcacagtttctaattggctagccgagattttttgatcggcaaagtccttgtgtgccgcttttaattctggagtacgtaataaactaccgacttggtcgaaacgatagggcgcttgtaaacttgttttagttgtcattgtaaaaactccttattatttatatttagaaacaaaaaagctcgtcctcaacgtaaaaacgtcaagggcgagcacttcattaaagaaaagagcgtgctcgattagttacgtatagctgccagccttgtgtatggtctatcaaagagaccaggtaaacaaaacctttaagccgaaaccctattttgaactagatgcggaaattttagctaatcagcaaaaattcgtcgcaaaattagacccctatcagcggtttaaaaacgaaacaggactaataacattcatgcaagctaagcacgttcagaaaggctcacaggccggcttaatcaaggacgtccaaaaacaagacaaaaagcgtgctagtccacaactattctcactatccagtctgcaaagtgccatgaataaacgttatcacgccagtgccagccaaaccttagcggctattcaaagcttatacgaagacaaactgctcagttatccccgcaccgattgtgcttatatcactgatgaagaatttagttatttagtggctaatctgacgaagtatctgggtttgatctctaagccagtcgctttaaccaataccactccgaacaaacgctatgttgatgggaaaaaagttgaagaacactacgccattatcatgactaaagtcgtgccgacgaaagagaaactagccagcttgcctaaattacagcaacaagtctatgacttggttttaagaaccacattagccatgtttgctgatccttacgaatatgaagaaaccaccattattacccaagttggtgacgccaattttaaagcaaccggtaaggtcccaactaagcaaggctggcaagctttatttgatgatcacaaagccgaccagcaagaagtagcaactttaccgctcgttcaccaaggcgatcaagtccaagcaaatctgcaaacaccgcaaaaagaaacgacaccaccggtcccctttaccgaaggtaccctgattacggccatgaagaccgccggcaaaacgcttgatgatgaagaagcccaagcgattcttaaagatgtgcaaggcattgggacaagtgcaacccgggccaatgtgctggaagtgttaaagaaacgcggctatctcgtcactgaaaagaacaagctacacgtcagtgaagccggaattactttatgtaaagcggttgaactcgaacccttgttaactagcccagagatgacagcaaaatgggagcaagcgttacaacaaatcagtatcgaagaacgcaccccggataactttttagaacaaattaaaaagtttgtatcaaaattgattgctgatgttcccacgcaattgactggcagtgaagccattaagcaacaaatcgatcacaagtaattacttttggaaattttaaaggtggcaccggtaaaacaacaaatgccacgcttgcatgcctggcactagctcgtgctggtaaaaaaacgctattaattgatttcgatcctcaagcaaacgctacagatatttactttaaaaccgcggctaatttaggccacgatgatattaaatttaatcaaaccttgcttgcatcaatccaagaagaggacttatcaagatcgttggttactttggataaaaacattgactttattccatcaagcgcagatttttcattgtacccacggattatggaaaaaaagtttaaaaataattataaagatagagttacatattttagcaagctacttgcttcactaaaagaaaaatatgattttgtggtatttgatttgccaccgactatttccttaatttctgatagcgccttatacgcttcagattgggttctgattatccttcaaactcaagagcacagtcttcagggtgccgaatcgtttctaaaatatatacaggaacaggtaatcgatgaatacgaagcacctagtttgaatttactcggtatacttcctgtgctattaaagaatggggcgcctgttgatcacagcacattagaagtagcagaagaagaatttgggaaagaaaacatgttaaaaaccctaattcgtaatatggaaagaatcaaaagatattcaatcagaggtgtatttctaaaagatcagttcgataaaaaaataattagattatacgattctgtggcacaagaaattattgaaagggcggactagcatggtggaacttttacacaatcctaactcaaataaaagcaaaataattcctagaaaatcggcgccccagccccaaaaagaaatttccatatcttctctaaacgaatcaaacaaaacgaagtctaaacaaatagatggtgttacttttgatactacgctcagaattgacaatcatctaaaaaactttatgaaagctatggtaattttagggtatagctcaactcaacaaaacggattagcccaattacaaaaaactttttttgaatcgttaactgagtctgaacaaaatacgcttacgactcaaatacagactttggaaaccggcgatgctaacaaagtaaaaagtaaataatcacgtgctctcagacgacacgttcaccttttagatgtatacttgtccgtttaaattaagcagaatgcacacaaaaaagtcctctattatgcggaatagagggcttttctgaaatcacacctctttgagcctggccttttccattccagtgctgcttgacattattattggtggaattactttctcaggttcactgattgcgactggtaaattgtccggacacgtgcccggcaaaccaatttcctttcccggcgataaattgattaacggtctggcagtgttagcgattatcgttgccggtgtgtggatgattggttttccttccgcatactggcctatggtactggcattgttagccagtttgatttttggcctattgatgaccttgccaattggtggggccgacatgccggtggttgtttcacttttgaacgcctttaccggtttagcggttgcctttgccggatttgtgattgataatcaggtcttgattatcgctggtgcgctggttggtgccgccggaacaattttgaccctgcaaatggctgaagcaatgaaccgatcagttgccaacattattgctggcggcttcggcagtggtgattccaatggcagtaccggtgcgggtaccgaagtgccaaccaatattaagaagaccacgcccgatgatgtcggtatgcagctggcctatgcgcacaatgtcatgatcgttcccggttatggtttggctgctgctcaggctcagcatgaagttgctgagctggcgaaattgctgacagacgccggaattagtgtcaattatgccattcacccggttgctggccggatgcctggccatatgaacgttttgctcgccgatgtcaacgttccttacgatcaaatgaaacagttggatgaagccaactcgatgtttgaaaataccgacgtatcattggttattggtgctaacgatgttaccaatccattggctcgtgaaaagggtaatgccatttcagggatgccaattttggatgttgataaatcaaagtctgtggttgtcattaagcgttccatgagtaccggttacgccggtgtccaaaacccactgtttagtgaagatcagaccagtatgatgttctcggatgccaagaagggactgcaggagattattgcggctaccaaagggtatctggattaaatgaagagtggggcgcgaggcgctttgatcccaaaatttaagtaaataatccagttattcctagttttggaatgactggattatttgcttaaatggccgggatcagccgattgtcccacgtttaatctatatgacagtagaactcaaaagaggcgatgacataactgacaaagaatcctcaattgtcaaatcaagtgcaacactaagaatctattcttagaagtggtctagttgctaagctagttcaggcattagatcggctgggcagcgatagttcaatgaccgccgtagccggttgtttaaggtatcttgagccagctgaatgtcaatgagtgaggccgaagccaaggatctgcccttcgggaagaactcgcgcaaaaggccgttagtgttctcattggttccacgttcccatggtgaataaggatgggcaaagtagatgtcagttcccttgacttgactcaagcttgagaactcagcaccattatcaaaagtaatggttttaaagtgctcggttccatagtcatataaggtattctggagggctttcaagcaagtgtcggcatgataattgggaagtttaacgatgatctctaagcgactaacacgttcagtcaaagtcattaatgctggctcagattcaacccgtttgcctttgaccaagtcaccttcccagtgtccaagctcttgacgcgcttgaaccatggcgggacgctcttcgattgaatggcccagatttttcttattgattcgatgatgctttgccccggggcatttaatccggcgacgtagtttagctggtaggtctgaattgcggataactaaacgctggtcatcaatataccggtacaccgtcggtgttgaggggcagacaagccttgggtgatcagtcttgaattggtggacaaaagtatccacactatgcatcctgggacgcgcttttaaagctgtcaccaaagcattacagaaggtttgacaatgatcaaagagtccacgataacagctatttagtcggtgcttacgataaattgcttcaccagtttctgccagatatgactgttcaaagatatgagtactagcgttaatctgtgtcgttgtcccacgttttaattcacgtgaaatcgtgctgggattacgatgaagggcctgggcaatccggcggatagaccaatctaagtcccttagggattcaattcgaccacgttcagctaaattgagttggtgatactgattagatatgatattcttaattcgggtcatgaagatacctctttcttgtttgtggtgaattaagaataggtcttcatggcctttttgactagtctgaataaagaactggtctagtagagcaggtgttgcacttcaattttaaatcgaggaaaacaaatcgaaaagaggaaattcagatgtccctaactaattctatcttatgcttattcgaaataacagacccaaacttaattgtcactggtatttctaaagaacggtgttccacaaaccaacgtattcatgtcgtccatgcaactttgtcttatcaacttttaaagtgcccacattgtggccataaaagcttaattaaaaacggaactcacatgagtcacctgcgtttaggaaccttatccggtggtcgttacgaaatgcatttaaaacgtcaaagataccaatgtaaagattgttcaaaaacctgtggtgctaaaactaagttggttaatcgtaacgaaactttcacacataatatcaaacatcaagtgatcgttttggcacgcgatatgttgacgagtaaagaaattgctaaactttgtggaatttcgccaagcagtgttcaacgaatcctaaatgccaatattcacttagcctatcgtgttaaacatctcccagagaatctttgctttgatgaatttcgttcctgtaatcactggatgtcctttaattgttgcgatgccgttagtcatcgccgaattgttactttaaaagatcggctaagtaaagatatcattgactactttgaagctcgtttttcggttcaagaacgtgcccaagttcaatcagtgacgattgacatgaatgctgaatatggcagcttcattcatcgcttatttcccaatgcggccacgattatcgatcgtttccatattattcaactggctgggcgtgccttagataatgaacgcacgcagaccattcgtactatccaagataagcattcacgaatttatcatattttaaaatctcaatggcgtttatttcatcttgatgaaataaaagttaatgattctaaggctgtttatttacgcggaattaacgagtatatgacgcaacaaaacgccattgatttagctctagacgcttttcccagatttagatctgtgtatcaaacctatcaaggtatcttaagtgccatacaccaaaaggatgctaatgcgttccaatccttacttactaactaccaacccactagtaatcaaatggacataacgatcaacacgtttatcaaaaatggttcagcccttctaaacagttgtcgttatccattttccaacggtccaattgaaggacttaatttttccttttcatttggagttaaataatcaatgctactgtgaattcgagcactgttataaaagctctcaatgtagctgaatattgcagcatttgcttcttcaaaatcctgataatggtgttggtaaacctcttcttttttcaaactggcgtgaaatgattccaaacatgaattgtcatagggacagccacgcttgctataagaatggcgaatatggtgttgcgctaagatctgttcaaagccagcactgcggtactggctacccagatcggtatgcacaattaagttattagtcgtctttctagtttcaaaggcttgttgaaaagtgctgatcacaagatcagcagtcatatgacggctgattttatgggcaatgattttacgtgaatataaatcctgaatgcttgataaataacaccagccattggctttggtgtgaatataagttatgtctgcacaccacttttgatttggactggttgtacgaaaatcttgcgcgagtatatttgaataatcagtcgcatcaatatcattagtttgttgataatgccacttcttgcgcgtgattgattttaaccccatttggcgcattaatcgttgaactagcttaatactggcagtcttaccttctttttgtaacgcttttagaattttaggtgccccgtagatacgtctagaattaaagtaaatgcgtttaatcgactggctaagtgtcttacgacgcttggcttgtggcgatacatgattctgctgatgttcatagtaagttgagcgtggaactgagagtactttacaggtttctttgatactatggtgcttcaaattaatatcaacggctgtctgccagtcatctgggtttactttttggcgaatatggttaaggctttttttaagatgtcattctcactttctagctgtttcaaacgtttttgcaacgctaaaacatctgatttggaaattccacttcctttgtcttctttatatagattaatccatttgtaaatagttacatttgatacaccatattcgtctgtaagatcagctaccggggcgccatcctggtacagcttgacaatcatttttctaaaatctactgagtactttttcttggtcataaaaacacaatccttcctattatggaattatactaaatcgtgtccatgatttcatactaccttcacgtgctggcttggaccgggtacggcatattggggctggtgaaaagcgccgtgcaaagtatgggcgcgtcaggggcaggggaagcagagcgttggcggagcagaagaagcgaaaagcggtgggaaacttgcagcacgcatggaagggtcgagatgggcagtgggggccgtgggattttgcacggggggctgttcgcgcgtgaaaaagtgcgcaagatgttgagtgggccggcagctgggtgcacgaggcggatatgggggtaaacgtgtgaacggacttttggggtatggcgggcagcagggccggggtatgcgctgggcaagagtgggaggcagttggacccgggctttcgcatgggcggccagagggacagcggcggagggtgggcgcaagggctccgttttggcggtgcaagttggctcgctggctgttggggatgaggcctaggtaacgcggggagcgtggtcgggaggttgcattgaggtggtagtaagtgtacagtaggtcgtagtggcggcgagagcggagttgggattgggtggtgaaattgccgttttggggagggccggccgaaagcagcgggggtcgggcccaggcggacatcgactttcgccagagtggggctggcacgagcagaggttgttgggcggttgcggacgcgttcgaatagtgttgtcccggacggacagggcggcagcggcggcggttgtgcggatatgggcgcaaacgtgaaagtggaggtggaaaatgcgatctcgagaacggcggcatttgaggtccaggtgaggccgggagacgcagcatagagcggcacagtagatgtagtttgctcagtgaggcagccgggccgctgtgggcggagcaggacgccgacttagaaaccgccgcagcggctctttggggtttgtacagtggctgggccgggctgcggtctggatggcagcggcagaacctggggccatggaggcggtatgcggagccagaagcaggggagcacagcgctgggcgtgcgtgcagcagaggcgggaaggcgtgcgtgcgccgcggagtgcgccgcattggcggtttgcgcgaggcctggctagaattgtgcgcggaggccgcggcgcgcagcacgtgccgccactccgcccaggcgcggaaaagcgccgtgcaaagtatgggcgcgtcaggggccggggaagcagggcgttggcggagcagaagaggcgaaaagcagtgggaaacttgcagcgcgcatggaagggtcgagatgggcagtgggagccctgggattttgcacggagggctgttcgcgcgtgaaaaagtgcgcaagatgttgagtgggccggcagctgggtgcacgaggcggatatgggggtaaacgtgtgaacgggcttttggggtatggcgcgcagcagggccggggtatgcgctggacaagagtggcaggcagttggacccgggctttcgcatgggcggccagagggacagccgcggagggtgggcgcaagggcttcgttttggcggtgcaagttggctctccggctgttggggatgaggcctgggtaacgcggggagcgtggtcgggaggttgcattgaggtggtagtgggtgcacagtaggtcatagtggcggcgggagcggagttgggattgggtggtgaaattgccgttttggggagggccggccgaaagcagcgggggtcgggcccaggcggacatcgactttcgccagagtggggctggcaccggcagatgctgttggggggttacggacgggtccgaatagtgttgtcccggacggacagggcggcagcggcggcggttgtgcggatatagccgcaaacgtgaaagtggaggtggaaaatgtgatctcgagaaaggcgggatttggggcctaggtgaggccgggagacgcagcatagcgcggcacagtagatgtagtttgctcagtgaggcagtagggccgctgtgggcggagcaggacgccgagttagaaaccgccgctgcggctctttggggtttgtacggcggcggggccgggctgcggtctggctggcagtggtagcatctgaggtagtggagtctgtatgcggagccagaagcaggggagcacagcgctgggcgtgcgggcagcagatgcgggaaggcgtgcgtgcgccgcggagtgcgccgcattggcggtttgcgcgacgccagactagaattgtgcgcggaagacgcgtcgcgcagcacgtgccgccagtccgcccaggcgcggcgcatgtcgggtaatttgaggttcggattaccaagtcctcaaaattggaaaaagttgtttgaaaggcaaactctctcttcaacaatgagtgaaaagcttcaattggcccattatcataaggataaccttgttttgagtatgagtggctaatctgatgccgttcaagtaaagtttcaacttcgttgctggtgtactgtgaacccatgtcagagtgaaaatattgtggcttttgatgacattcaagcgcctgattaatcgtttctacaactaacgtcgcctccatctgacgaccaatcttgaaagcaagaacttgatgaacctttggttcgtaaatagaactgagataaacccaggttcctggacgtaattccaaataagtaatgtcagcacgccatatccttgcattgggctggtgcttgattaaattggggcgttgtgaatgatccacatgagtgccaggttttttaaatcgccgattcattaaagagtgaatctccatttccctcattaatcgtaaaattcgttttgacccaacacagatgcctgacttgcgaagcaccatcgttattcgtggataaccataggcacgataattattttcccaaatcaatttaattttttctttgagctgattatcaacacgttcgtgttgactaggttgatatcttttccaatggtaataggtgctgcgcggtaatttcagtgccgaaagaataattgataagcggtgtcgcaataactgatcttctatgaagacaaggcaattaattcgtcctaatgctttcccagtaacaccgccgcagcttttaaaatttcaagttcctcctttaatcgctgattttccttttgaagttgtttgaattctttggacgttacttcagtaccgtcttctagctcaactgatttagcgtctttaacccagttatgaattgcggctggagaaacaccgtattcctcggaaagcgagcgaatagatcttttctcttcacgatgcatcttcacaatgctggctttaaaatcatcttgatatcgtttcattggaatgctcctatcttgttttattaattatggcacaactgttcagaaatttatgtaccaaatactaggataggagcaagaaagcgccgtgcaaagtatgggcgcgccagaggcagggaaagcagagcgttgacaaagcagaagaagcgaacagcggtgggaaacttgcggcgcgcatggaagggtcgagatgggcagtgggggccgtgggattttgcacggggggctgttcgcgcgtgaaaaagtgcgcaggatgttgagtgggccggcagctgggtgcacgaggcggatatgggggcaaacgtctgaacgggcttttggggtatggcgcgcagcagggcggaggtttgcgctggacaagagtggcaggcagttggacccgggctttcgcatgggcggccagagagacagcggcggagggtgggcgcaagggctccgttttggcggtgcaagttggctcgctggctgttggggatgaggtctaggtaacgcggggaacgtgactgggaggttgcattgatgtggtagtgggtgcacagtaggtcgtagtggcggcgagagcggcgttgagattgggtggtgaaattgccgttttggggagggccggccgaaagcagcgggggtcgggccgctgcggacggcgacttttgccagagtggggctggcaccggcagaggctgttggggggttgcggacgggttcgaatagtgttgtcccggacggacagggcggcagcggcggcggttgtgcggatatgggcgcaaacgtgaaagtggagctggaaaatttgatctcgagaacggcgggatttgaggcctaggtgaggccgggagacgcagcatagcgcggcacagtagatgtagtttgctcagtgaggcagcagggccgctgtgggcggagcaggacgccgacttagaaaccgccgcagcggctctttggggtttgtacggcgactgggccgggctgcggtctgggtagcagtggcagagcctggggccatggattcggtatgtggagccagaagcagggagacacagcgctgggcgggcgggcagcagaggcgggaaggcgtgcgtgcgccgcggagtgcgccgcattggcggtttgcgcgcggcgagactagatttgagcgcggaggccgcggcgcgcagcacgtgccgccactccgcccaggcgcgcagccattgtttcacaagaaaaaatggactggctagaaagagcattaaaagctaaagaaggttcgttagaatatgcaattgcacgtgatcagttaattaaacgtcatgttttacctgacgatgaaattgttgaatcagatgatgattattggggccagtttaaataattaaaaaactaagatttaaaccacgtgcaacctttaatgctgatctaaaacggttagccagtttagacaaatctattattgatgaagttcgagcagccattgacctgttgcttgagcaacaacaattaccaccagaatttgaagatcatgagcttaatcggcgaatgagcggttataatgaatttcacttacgagataccccgaaaaacaaaacaccaagcgaaactaacgatgtcctggtggtttatacgattgataaagatgaactagtcttaattggcattcgagtcggatcgcatgatcgtttatttcctggtcaaaatcgttccaaaaggtatcgaaaaaatgacgaataagagaagtcatttataccatataaaaacaaataacccccaacatctacattatagatattgggggttattttaacaatgattttgaggggttatttgttaattatagaccctatatattcatagcccctttctgtttggtgttaaagtattagtcatcgatgtcatgcactatcttgtttagctccgttttgatggaactggaaatattttctaaattgaaatgattatatatttctttatccttaagcatccttttttgtgccttatttaatttacactcattgttacccactacccattcatcctttgtacgtataaaggggttttgcgcactttcctttaacgcgttttgaacatcttcataaggtaaataaaattcaattgtagatttatttaattggtagattgtaaaattagtccgaacagcgttcggattaattttacaatctaccaattaacgtctccatcttttcaaaacgacttaattctacgggctataaataacttaatttgccagtgtataacgtttcatattaagctaccactaagttataataataaagacaccaaatgatcaatttccataacaaaagatacttaaatttgatgtcgatcagacaatgctttaaactaaagatgtaagcggttaatagtcatttaaaaggagtgattttaatgtatgagcacattttagtaccacttgatggtagtgaaaattctcgaaaagcattagatgtcgccattaaattggcaaaaaccttctcatccaaactatcattactatcaattgttgataatcgtaattttgcaatgccggcaactacagccgctgcgctaaacagcagctattctgaattaaccagttatgctcacgacattgttgacgacgggctgaaaaccgttaaagaaaatggcttggatgccgagacaattgtcactcaaggatatccaaaatcagtcattgcaaccgatgtgccaaagcaaaacaacattgatttaatcgttatcggcaaatcaggtcggggtgctattgacagattcattatgggttcaacaactgcttacgttgttagaaacgcaactgttcaggtattggttgttagtgatgatgcataggccagtactattatagtaacaatcttttaaattcataacgaaagggcacttatcagagacataatagtcgtctcaataagcgcccttttaatttacttggatgaaaaggttgttgaccaatacgtggaaatcaacaagttagccacaatccctaaaacagtcgacttcatagcaaaaccgctaaatgcctgtcagatcatttttaccacagatattgaaccggatctttaatgtatttgtcgtaaacgtcacgcacaattgccatctgatcatcacttaaagccggcaattcagctgcagttgtattgcgttcaatttgattaggattacttgcaccggggataacggcagaaacagcatcatacattaagataaatcgaagagccattgcggccaggttatctgttccgagtcgctctttcaattcgtcagcggcttttagaagctgtccaagatctatgatttttgatatacttctatgtaaaaagcgagtttaagctatgaaaaattattcgcaacacttacgagccaaatggccgcctgatttaatgctttccatggttcaaataagttattaatcacgattaatgatttatttgagctgtggaaggtaaacgcggttctgaatgtctcttaaaacctgtctcaaatattgacttcaatccaccaaagaggaatatcggattgacaaacaactggataagaacttaaaacagcgtcttcgtaaatagggcgtttttaatttagttaaaaagaaaacaggcaagcctaattagcttgtctgcaaatcaaaaactacttatctgattttttcttgaggtcatcgacagtgtctttaacggcatctttagcatcggcaattttgtctttagccttaccaagaagtccctggccttttccttgggcttctctagctttatcgccggtagctttgccttcaacttctttggctttaccgctgaccttatctttagtactatctgctttatcttttagactcatgaatagcacctcctctttatgcttaatccaaccttattgtctggcatatatatgaataatgcaattaattagtctaagagttaatctgattccggttttaaatcattaatatcattctagaaggctatttctttttataggatcaatttatatcagaagcatttaacgctttgataatcttctcattttgtgcaattattatccaattttgttcaactaatgctcttaagaaagatgtggcttcaagtgtagaacggtcaataaaataattcttgctattattttttcttaaaacattttttcggtcaagttctcccagaattgattcgactgcttcagcagtttctgggccaacatctcctaatccacgctcattaagcaattgataaattttattattattgagtattgtcatcgcagatgcctccctaaacaattgcacggcaaacaaacataccacaacatttacttttattatctcacggtaaaccattttttagaaatataacagttaaaaggtagattgtaaaattaatccgaacgctgttcggacaaaaagatcagcttcctcttagtaacgtttttatgatccgctaaattttctttgacaaaatctttagcacttaggactggttcgccgcttgtctgtgatatgtcaaatactggaatatagcgataaccaactatggctttttctttggtcgtatcaagccttttctgatcctctggagttagttttttaatcataggggccgcaatcctgatccctttttctcccttattaactgatctgttaaaatcatttttccattgtttaaaacctgctatttgagtagcttctgggttttgagagtagattaaatcaatatttctagcgctataacgatgaaattttgccacagtattaagatagttcttgaacttgtcactatcagttaagttcaaaatttgttgttctgcattatctacaagttgtttcttccattcttctttagttggcatatttaaacctcctcggcgtctacaaactctacagaattatcaatttggggtaacttgatagattgtgtgccgtaaagtgctaaatattcagcattctttttttgccacgcaacttgaatatatttgccattacccgcaatttctgataggtacttataactgcttttatccgtcaaaataggtaattcgcttgctaatgcttccagttcatttttcatgatatatcctccttcttttacaattacactcgttggttaggttcactttttggtttttgaaaagtaaacctaaatgacgagttcaccaaccgaaacaacgtgcagggcggtaggcaggttctaatcaaaatcaaaacttaatttatggccgtcaagctttaacttggcgtcaaacgactttccttttttactcttgaaaccctttaatttgctcgtttcccccttggtgaccagcgctttaattgcggtcttaccgagggtcttactgctccatttcttgggcagggtaaagctttcgccttgcttaggctttacaatgtaaaacttctgtttatttaaaacggtcgcttgcggtgtttctaagaagacctcgtcggacttttgtgcttgctgttgtgggaagaactctcttaattgaccattcacattctcattagtgccccgttcccagggagaatatggatgggcaaagtagatttccgttccttgaacctgatttaaactagcgaattccgagccgttgtcaaacgtgatcgtccgaaagttttctgcaccgtaatcatcaatcgtatcttggagagcttgccggcaagtctctgcccggtaatcaggcaatttaacgataatttccatccggctaactcgctcggttaacgtcattaaagctggttcggactcaacccgtttggctttcactaagtcgccttcccaatggcccaactcctgacgtttccgaaccactgcgggccggtcttcaatggactgtccaagccgttttttattcaggcgggcatgtcggtgattcgggcgtttaacgcggcgacgtagcttcatgggtaaatcatagttgtgaagctccgggagcttgccagcctcgatataccgatagaccgtagccattgatgggcagggaaagcccgggtaatgagctttgaaatagtggacatacgtatcgacactgaaaactcgtggcttagcttttaaagctttcggcagggacttgaagaacacggcagcccgctgcagtaaacctttggggtgacacttggcccgctgttctcgatagtaagccgccccgcgctcggcaaagtagccctgatatgaccgatgtttctgggaatcaatctgggtggttaacccgcgttttaattcgcgagaaatggtgctgggactccggtgaagccggctggcgatctgacgaacgccaaatcctaatcgagtcagggactcaatttgaccgcgttcaaaagattggagttgttggtaatgcttaggcatgatattcttagtttgggtcatgaagacacctatccttatctgttgattttgtcgttaataataagaataggccttcatggccttttaagctagtctaattggtctagttatcaagtgttgcacttagaaaaaaactttagtaaacaccctccaaaactataagtaaagaaaatagggtccctattttcttttaataccgtatttcacacggtatcgaataaaggtcgtccgtttaatacctgtatttcgggcaacatcgacatcactcatgcctgcctgataaagtttaaaagcatgttgcaagcggggatcgtcttgggtgtattggggtttgcgcccatgatatttaccctgctgcttagctaaggcaatcccttgctgttggcgctcaatgattcgcttacgttcactttcggcctgatacttataaagttcaataatgaggttggtcatgagttgacgtaaattggggtcagcaatccctgtcatggacggcaaatttaacacatctagggtgacccctttattttgaatggtgttcatgatcttagttaaatcctggttatttctgcctaagcgatctaattcagtgaccattacaatatcaccctcacgaatataggccaacattttttgcagttctggccgattcgtggtggccccgcttaatttatccgtaaacagtttatcaacgttttttaaagccgttaactgccgatctaaatgttgctctctggaacttacccgggcatacccgattttagccatttttagcgcttccttttggacagttctaatgaacatttgtaattcctagtatagcacagaatcaaaaaaggccaatagggtataccctagtggcctaaaaataaaaaatcaatctaccaaattatgaagtctaaacgctaatctgttcgcgtataataaactagtgagtaatttaaaggtgggggaaggaatgtttttatgttggaactgtcatttgaaaaagaagttgttaaaaccttaacgactggaagcaatcaatgggtggaacgcaaagacctatatggtgcgaccccggatcaattatgggctaattttcgtgataaattaaacaacaataactatgctaaattacagggacaccctgcgtctaaacaaacatcacaggaggcttccccatgaatcagtttaccaaagaaatcgtcacagcactagcgcagcgtcaggatctagatattattttcaaagatcaactagaaacggccgttaatgagctattacaaaatgaactttctgcatttttaggttatgagccctatgataggaatggcttcaattcaggaaattctcgtaatggccactacacgagaacctttaatacaaaatatggcgaattgaatcttacgattccccgtgatcgaaacggagaatttgttaaccacacattaccagcctatcaacgacgaacagaccagttagaacaaaccatcattcagctttatcaaaagggaattaccactcatgagatcgccgatctgatggaaaaaatgtatggttcctattacacgccacagacagtttccaatctaactaaggtagttaacgaacaagttgaagcttttaagaatcgaacgttatcagaaaggtacgctgtcgtttatttagatgccacatatcttcccttgcgacgtgacacagttgccaaagaagcagttcatattgcgattggcattcaacctaatggtcataaggaagtgctgtcttacaagatagctccgacagaatctagttctgtgtggtctgaagtattagctgatttgaaggatcgtggcgtacaacaaaccttactttttgtggccgatggattggttggcctcgaaactgccgttggtaaatattatccaaacgccgttattcagcaatgcctagttcatgtaagtcgtaatatttcgcatcatgtacgggttcatgaccgtaaagctgtgttaaatgattttaagttaattcatcaagcaaccaataaacgaatggctgagcacagcttagccaactttgttgaccattggcgcaaaagatatcccaaagttacgcaagctttattaaagaaccagaaattactggtattttttaattttccaccggctatccggcctccttcatctagcttaattatatcattatcaagcaaacaaataaacaatttattaaataattaacgtaacgattttggccggtttaatcatgtacttcggcaatatcaacagcactcattcccggctgataaggcttgaacggctctggtgcaaatagtctgagagtgtgccttttacctagttgttgatagggtgttgtaggttatgctggcaccatcgcttttaattcatccacggttgaaaacccgatgaggcttagctctcgtcgggttttcttgcgtaatgcatggatgacttcaatgccgctgagtgttgcactagcggttcggatgctttggaaacttgctgaccgcacccggtgtcgtttaatgaatcgatgatcttgttcgattaaattgtttcgatacttggaacattggtgtgctgatttgctcaagtagtcttgtttcatcaggtgcttcactgccttaagtgttgctcgatattgatcggtgactaagcgatcaggacgaccattggtcgtcaaaagccgtttcaaaaagtgataggctgccgcataatcacgatgctttcgcagttcgaagtcgagcgtcagaccgttgctatcaattgcacgatacagataagtccaatgacctttgacgttaatgtaagtctcgtctatcctccaacttttggtatgggaggtttgatgttggcgccataaagccttaaagatgggaccataatgatgaacccaacgcatgaccgtggtgtgatgcacactaaccccgcgatcacgtagcaattcaacgatatcacggtagctgagactgaacctaaaatagtagccaacggctactataatgatatcctgttgaaagtggcgtcctttaaagtaattcatgcgcacaatccctcgtttcttgtcactcagtatactagaatgaagttgccaggcaaactttgcaccagagcctaagctaccactatgttataatgactgaaaaagaggtttggccgtattcaattgatgaaagcattcttgatatgacccatacttggcggctgtttggcaattccgttcgcgaagtggcacgcttgattcaaaagacagttcggcaaaagctaggcttgtataccaccgtgggaattggtgacaatccggtgcaagctaaattagccttagacctttacgctaaacataatcatgaattgatcggtgaaatccattacgaaactgtgccggataaaatttggtcaattactgaattaacagccgtttgggggattggcccccgtatggcgaaacgtttgaaccgtcttcacattcacaatatgtatgagctagcccataccaacccttattactcaaacaacaacttggcatcattggtagccaattatttgctacggcctggggaattgatcgcgcacaagtcacggaaccaactaaggttaaagaagctagcctgggtaattcgcaagtattgccacgagattattttaaccaagtcgaaattgaaaccgtcattaaagaaattggggaacaggtggcggcgcggcttcggcaccaccataaactggcggggtgtctatcgctaagcattgggttttcctatgccgcagctgaagcagatggtcgcggtggctttaaccaggctttaaaaattgaaccaactaatgacaatcaagttttgacgcaacaattattgtggttattccgtcagaattgggacggtcaagctgtccggaatattggtgtttatagcagtaaactaagtgccaactccggccaacaacttaatttatttgaaaccccgcgcaaccaaattcgccgtagccggttaaaccaggtgattgatgaaattcaccggcaatttgggttcaccaaactagtttacgcgaccagtttattaaaggggggcaccgctatcaagcgggcttcactagtgggcggacataatggaggtagaaaatgaacgaatctgcgaagttgttacctcaaaaatatatggaaggcgataaagtgcacgttttaggtattgatgtgagtcgtggaaagagtaattgtgctcttttacacgatcatacggttattaaggagtttcagattatccataataagtctggattggcaaagctcaagtcaataattacgagggacctgccagtcatggcagtatttgaaacgactggtatttattctagagttctgactcgtttttttatcgatgaagaaatgaattaccttgaaataaatcctttggagtcctcaattcgcatggcggggttgagaaggcaaaaaacagaccgttcagatgcagttaaattagcgctcctgggaattgatcagaagtcactgattcatggtcgtagaccatattcaaggccatatgagcaacttcatttaatggcacaccgctatctagaaataactaaggagagatcccggattatcaatcatttacatgccgcacttgatcaaacatttcccgagttaaacgatatatttaacccaattcgatcagtgctcggcttaacttttgttagtctctttccccaccctgattttttaacaggatatattccaggaacgatggcaaaacaaatcattggcttggtaagtcctaaaatccattcggatttaatcgtacgtagatgtaatgaggtctggcaggcaggccaattgtcgtacccagcacaacctgcgaattcatttctgactaatcaaatccatagttattgtgaagagattcagcgatataatcaggcccatgacttattaaaacgccaattgatcacttacgcgaaaacttttccggagtttaaactcattgcgagtattcctggggcgggagagatatcaactgccctgttactaggatttacaggaaaaatagcgagattcccaagctataagcagctgaatgcttacgttaactatcataagggagaggcttccttttttcaatgaatcatttacacataattatttaaacactcgatttagccttagtctgttaattataaatacgcaaatcttttattttttgttatttacagaccgtacaatagtatattcttttcaaaaatcggtataatgggcacaaggaggtccttcaaatgtcaatttatgattacacagttacactcgaaaatggcgagaattactcactttctaaatatcgtggccagccgatggtcatcgtgaataccgctacaaaatgtggtttcgcaccacaatttaaacaactagaacaactttataaaacttatgctgatcaaggcctcatcgttttaggttttccatctaatcaatttaaacaagaggtttcttccagcgaagaggctgcagcagcttgtcgcactacttatggtgttagtttcccaatgcacacaattgccgatgtaaatggtaaagatgccctacctctgtttgcatatctgactaaaactgctcctggtgcactgggttcttctgcaattaaatggaactttacaaaatttctcattgatcgtgaaggcaacgttgttaaacgctatgcacctaaaacaaatcctttgaaaatgaccgacgaaattgaaacagttttaaaaagtagcgtaaaataaaatcttaaaaacaaagtccttatccgcgtcaaacagataaggacttttttaatcctgtaataattgtagtagtttcaatgccgtattcagatttcgaatcgtcacatctttataaagggcttctttcatcagcttagagtaaacggacttgctgaagtcttttttgaaagtggaggtccaaaaaatgactttcgatttaagtgctcctatgtcaataaatggcacatctttttctaaacactcgttctaattctgtcggaattaaaccaactgattctcatcagtcgttacttggctaaaattggtctttttcgggaagaaccagcgtaaccgtctattaaaatattcattggaacctcgctcccatggtgaatatggatggcaaaaataaactttgatctgataatcctgttctaaggcctgataattggcaaactctttaccatgatcaacagtaatggattttacttggggaccgaaggcccccataaacttgccaaaggcggtgtttagagccttagccgttctattaggggctttgatggcccatagaagtcgggtcttacgttctacgaatgtaaccagacatgatcgtggctcacttcgactagaaagcaccgtatctacttcccaatgaccaaaagctaaccgttgattaacagttgttggccgttgttcgatggaagtcccacttgtaaatttcccacgattttcgctcactcggtgctggcggacattccgattgggtagatcagtcaatttgaaggggagccagccacgattaagccaattataaattgacgcagtgctcaagttataagcggccgcaatggtttctggtgaccaggttaatcgtaagtgattggtaattaaagtcgctaatgctgccgtcagcatcgaacgacgaccgcaattccgccttttgcgatctgcatcttgctgagctaattctggatcataaggtttaacccggtccaactcatagctaatcgtagctttggcgacgcctaaggcgtcagccattacttggtaagatttatttccctcattgaccagttgtgctagtgcgccacgttgaaaacgtgataaagtagatgtacccaaagtaatcactccctatattggttggaattagctactaccattgtaagtgattgctttgggctttttaatttctgttcggattaattatagaatttgccttacgactgctcggtactcattgttgctctttatgttgacgacttgttgatttgctccaacgatgcagctcagatcgcagaagtgaaggctctgttgtgttcccactatcaaatgaaggaccttggtttggttaagacgtttttaggcatgcaggttgctcaaacagccactcaggtttcagtcaagttgtcccactacctttcggagttccttgctgacttcaatatgcaggactgcaacccagtcaccactccctttgctgccggtcatgactttatccctggtgcacccatttctgatgctgatactaccagatttcgcagcatggtgggcaagttgttatttgctgcgaatacctgtcgtccagatcttgcatttgccgcttcaacactgtccagatacatcaaagatccccgcgataatcatgttgctgccgctaagcatgttctgcgatacattaagggtacacttgaccatggcttggtgtatatgaagtctgatgttttcaaaattgtcggtttcagtgattctgactgggcgggtgataagtatgacagaaagtccattacagggtacgttttcatgttggctggtgctgctattacctggaagtccaagaagcagcctactgtcgctctttcctcaacagaagcggagtacatggcactaggtgacacggtcaaggagttgttgtggttgactcaactgttggaacaaattggtttacatttccctgaaccctctgttatctatgaagacaatgaaggttgcaagctgttatcaagtcatcctgtgcatcatcaacgtaccaagcacattgatatcagacatcactttattcgcgaccacctcaagaataatgattttgttttggcttctgcacgcactgatgacatggcagctgatatgttcacgaagaatcttggagaacgtgtttagaatcttttcaagagtattcgcaggaaggctaagctaatcatcatcttactggtgttcagctttcgctcacaattgcgccagaagcgccgatattttcctagccagctaaaactgcgttcgataacccagcgttgcggggtcacttgaccgtgcctaaggtcactctgtttagcaataatgacttcagcgttaatcattgcctgaactgattgagcaaagttgttaccagtataaccaccatcggccattactcgttgaaccaggtcaaactgtgatttgtttaacgccagtagcgcattggcgccatcacgctcagaaacattggcggttgtcacatggactgccatcggcagcccattgatatctacagcaagatggcgcttaatcccactcacctttttaccaccatcgtagccgctactttcagcaggatcggtattcttgacactttgagcatctagaatgatgaacgatgtataaactgaacgcttctgagccaaccgatgttggctgacaatttttttaaaaccttatccagaggagtgataccagcaggagatggcgttttagtccaaagtaaccagtaataataaacggtttcccatttaggaaaatcgctgggtaaatcgcgccaaacgcacccatttttcaaggtataaagcagggcacaaaagatatcatataaatcaacctttcttggcttagtccgcttacgtatgccttctagatctgtccggattagttcaaattgttcacgagagatgtcgctactataatggtgtgcaaagcttttcatggattaaaaactcctgtttttgatctaatttaactaaaatcaaatcgaatgtcaaagtatccaaacacgttctactgtttgagatctaaattgagttttggtatacttttgcaaaaaaggaaattgttatgcctaattatcccagtaatattactcgccaacagtttgaagtcattcgctcagaactagaaaacttttgtcaacggacgaagccacggcaggttgatttatatgacgttttctgtgccattctatatatcttaaagaccggcgctcaatggcgggcattaccgcatgattttcccaagtggcaaacggtctacacgtattttcgcttatggtctcggcaaccaacgccagcagagccatcactgttagatcaggttttaaaaaaattgtcgctaccttacgatccaagcaggatcgttcggcgttaacttccttcattatcgttgacgctcagagtgttaaaaataccgaaacggccgagaataaaggctatgatgccggtaagaaaatttccggaattaagcggcatctagcagtggatatgaatggctttccccaagccattcatttaacgcgggccaatgtctctgaccgtgacggtgccagtgccatgttagccttaaacgccgaaaacttacgccgggttcgaagcgtattggttgatggtggttacagtggccgcaatttcgccatggatgtccagcttaatttaaaagcgaccacccaagtcgccaaacgaaatgagttacataaatttgaagtgttgccacaacgctggataattgaacgctcctttagctggttggaaaaatatcgtcggctctggaaaaactgtgaacgacagctgcacaccagtacagcgatggtaactttagcgtttgtctcagttttcctacgccgcttttagagatctcaaacagtttcttgaattgtcaaattaagtgcaacactacattaaagaatatttcataaggcgttttccatccgagacatttacggggacgattattcatttgttctgcatatgcttgtatccggcggtcagtaattgaatcaaggtcagttccttttggcaaatattcgcgaagcaagccgttagtattttcgttagttcctcgttgccaaggagagtgaggatcgggaaagtagaagggcgtaccaaacttatcagttaaacattgaactttggcaaactctttacccctatccggggtaatcgttaacgatctaccaggccatagcttcattaagtcgctcaaagtatccgtgactgcttctgaagttcttttagcagctttaccaataagcaggtaacgagattttcgatcaaccaatgtaacgacacaagcctttccgcttttgcctaacacggtatcaccttcccagtgaccaatttctacacggttgtcagcttctcgcggacgatcatgaatcttgttggggattggaatcttgcctcgcttttcttgataagctttattgtggcgagacttgccgtgatgccttagatggcgcacggcactagagctgccagatttaaacaaattatcaaataagccagtgaaaatcccacggtaaatagtcgtggtactgatctgcaccggatacttttcgactgccaagcgattcgatatttcctccggagaccaaaggtcttcgcagaagtgttctctcaccacttcaaacacctgaggattactcaaaagagagactctgccacagttgcctttgcgctgtttgtacttctcctgagccttcgaaggtgaataggttgtaatcatcgctggtgtactgtgatcctaagtctgtgtggataatcaggtccccagtaatggttcgatttttaaccgcgctttccagggtctttaagactaaatcagtagccatcttttttgagaatgaatagccgataattcgtcttgagtgcagatccatgatggttgataagtaacaccagccattacgcttcgtttgaatataggtcatatcagcggtccatttttgatttaaaccagtggtcgagaaatcctgcttaagcaagttgggacgctgttcaaccttggctttggaagccgaagccgctttccatttattgacggtaacggagtggatatccagttccttcatgagccgggaaatccgtcttgggctgcaccgacgctgcagtggttgaagttccagattcaattcatggtggatcttcataacgccgtatcgctgcttgaattccgcaaagatccgcagaatccgttgttttaagtcctcatcttcggcccggcgttttgaaggctttggggatcgataacgataatactgagctctggaaacaccgaggattcggcacatcttagttacctggtggtgatggctttcttggtgaatgtaatcaaaaatattggttacttctgcgcaaggaagcccagggctttttttaggatttcgttctcctcagacagggaagccagccgcttttccatcgctttaatttcgtctggcgatttaccggattgagttttggcttggccctggatccacttatgaacggttgaatagccaatgccatattctctggccagtttgagagtagacctctcaaaactaaacaaaactttcgacaatgtgcaggattccgtttttccttagaaaggaggtgatccagccgcaggttctcctacggctaccttgttacgacttcaccctaatcatctgtcccaccttagacggctggtccccgaaggttacctcaccggctttgggtgttacaaactctcatggtgtgacgggcggtgtgtacaaggcccgggaacgtattcaccgtggcatgctgatccacgattactagcgattccaacttcatgtaggcgagttgcagcctacaatccgaactgagaacggctttaagagattagcttgacctcgcggtttcgcgactcgttgtaccgtccattgtagcacgtgtgtagcccaggtcataaggggcatgatgatttgacgtcatccccaccttcctccggtttgtcaccggcagtcttgctagagtgcccaactgaatgctggcaactaacaataagggttgcgctcgttgcgggacttaacccaacatctcacgacacgagctgacgacaaccatgcaccacctgtcattctgtccccgaagggaacgcctaatctcttaggttggcagaagatgtcaagacctggtaaggttcttcgcgtagcatcgaattaaaccacatgctccaccgcttgtgcgggcccccgtcaattcctttgagtttcaaccttgcggtcgtactccccaggcggagtgcttaatgcgttagctgcagcactgaagggcggaaaccctccaacacttagcaccagtggacatgaaagtgtattattgaccttcacggaacgtaaaactcgttatgatattgttcgcttgattgaaggcaaagatgctgattcggtatcgtatgcacttaaggggatttgtgctgaatttggtgatcttattaaatctgttactgctgacaacggaacggagttcacagccttgaatgaagtcttagacggcgtagctgacatctattatgcccatccgtatagttcctttgaaagagcaaccaatgaaactcataaccgcatgattagacgatatttacctaagggacattcattagatacgattggtcccaagacggtttcaatggttgaaagtcgtctcaaccaattaccgcgacgtatcttgaagtatcaaacaccaaaagaagcttttcaaattgaagcagcacgtattcgtaaagcatgtagtgcgtagccattatcttgaccttcaatagatattctgacttgcccgcaacttcgcctgcggggtggctaacttgttcttgcaatttccgtaatgtttctaatagtaaaagttcttagtctgacaatgaatgactttaagtgcgttacaagattcataattctctcttccctcacttacaaaatataaagttatatataattaaaaatatcaaagcaacttatatgatagcataattacgaataatatttagtacccttaataaagaatttgtcagtatttgatacctttaccaacctcacggaaaaattttttctcgttagttaatcgttaacgtgaaaatgtgtttcgacaaactcagttcagcgtattttgacggctaatattcatccacacgcgagccgccggttaccgattaatctatgctttgatgaattccgttccacgcacggctccatgtcgtttatttgcattgacgccgacactcacaaatcagttaaagtacttagcgaccgccttaatagaaccatcaaacagttctttcttagtcagtacagcaccgcagaacgggccgcggttcaacgcgtcatcatggacatgaacgcctcctatcaggcattcgtgcacgaactattccctaacgccgaactcattattgatcggttccacattattcaattaatgggccggacgatggataccattcgcactcaatgtttaaagcaactcgacaagcattcgcgggaatataaagtactgaaatcactatggcgcctattccacaaggccaaccctgacgcacaaaagagccgctacctcttcggcctgaatgagtactcgaccgaacagaacgctattgatattggaaccgatacgtttccggccttcaaaacagcttatgaaacctacatcgatctccacgatgctttgatggggcgtcacgctgatgaactcaagaatatcatcactaactatcagcctaacggcacgcccctagatacggccatgcataccctacgaaagaatcttaatggagtaattaacgccgccaaatcgtcctactctaacggaccgatagagggcatcaaccgtaagatcaaggagctcaaacgtgcttgttacacccattatactgacctccaattaagtatcctaatatacaaggatacttggatacaaggatgataacatacaaagatacttagatacaaggatacaaggatacatttcttctcaaaagccgttaaattaagattgactgcaagtatcctaatatacttagatacaaggatacaaggatacttagatacaaggatattaatatacaaggatacaaggatacaaggatacataaaaagaaatgttgatttatcaccaaacaacgagtaatattggttacataaaatagaacataaaaaaacacccaccgacgggaatcggtgagcgccacataaaagtcaacttgtttaatgactattatatcatggccggtgcgatttttaaagccctaggggacaagctggggtctaaatccaaggggacacgtttgccagggcgacttcaataagtctggctataccacaacaaggtcatctgtacggctgggtggtgaatggtgagcgcgaccattaacggcgcgagtggtaaaacgaagcttcggcttggtgccactgattagttggtgatcgaacaaacataaatacgtatcgtcaacgcctactagggcgttttttagtaggttaaaccgaaaacgtaggtttataatgagtggtggtagcaataccgcaattgtacagacaagcgacgggcgttaacgaccgacgaactagggggaaaccttagcgtagaattgcactctggttcagttattccaaatagctgtttccaaaattttggagcaaacaatttgcgaagtcaattcgctttaaacaatgaaacaacaaatgagcttgtaaaaactcaagtataatatgagagtttgatcttggctcaggatgaacgctggcggcgtgcctaatacatgcaagtcgaacgcactttcgttgaatgaattagaggtgcttgcaccgaagatgattttagctataaagtgagtggcgaacgggtgagtaacacgtgggtaacctgcccagaagtgggggataacacctggaaacagatgctaataccgcataacaaagtaaaccgcatggtttacttttaaaagatggcttcggctatcacttctggatggacccgcggcgtattagctagttggtgagataaaggctcaccaaggcagtgatacgtagccgacctgagagggtaatcggccacattgggactgagacacggcccagactcctacgggaggcagcagtagggaatcttccacaatggacgaaagtctgatggagcaacgccgcgtgagtgatgaaggctttagggtcgtaaaactctgttgttggagaagaacgtgtgtgagagtaactgctcatgcagtgacggtatccaaccagaaagccacggctaactacgtgccagcagccgcggtaatacgtaggtggcaagcgttatccggatttattgggcgtaaagcgagcgcaggcggtcttttaagtctaatgtgaaagccttcggcttaaccgaagaagtgcattggaaactggatacccattatactgacctccaattaagtatcctaatatacaaggatacttggatacaaggatgataacatacaaagatgcaaggatacaaggatacaaggatacatttcttatcaaaagccgttaaattaagattgactgcaagtatcctaatatacttagatacaaggatacaaggatacttagatacaaggatatgaatatacaaggatacaaggatacaaggatacataaaaagaaatgttgatttatcaacaaacaacgagtaatattggttacataaaatagaacataaaaaaacacccaccgacgggaatcggtgagcgccacataaaagtcatcattgtttaatgactatcatatcatggccggtgcgatttttaaagccctaggggacaagctggggtctaaatccaaggggacacgtttgccagggcgacttcaataagtctggctataccacaacaaggctatctgtacggctgggtggtgaatggtgagcgcgaccattaacggcgcgggtggtaaaacgaagcttcggcttggtgccattgattagttggtgatcgaacaaaaataaatacgtatcatcaacgccttctagggcgttttttagtaggctaaaccgaaaacgtaggtttataatgagtggtggtagcaataccgcaattgtacagacaagcgacgggcgttaacgaccgacgaactaaggggaaacttttagtagtagaattgtactctggttcagttattcacggaatcaactgggatctggactgaattgctgggaaccctgattaagcaaggtgtcaaagatgtgctgttgtttgtggccgatgggttagttggtttggatgaaggcttaaatcggcattttcccaaagctaaacgacaacgttgcctggttcatgttgggcgtaatttgatgaacaaagttcgtgtgaaagaccgtaaggccgtgatcaatgactttaaacaagttcatcgagctgccaatcgtgaagcagccgaaccgaaactgaatgagttcgccaacaactggcatcgtacctatcccaagttaatcaaagatctgcttaaaatgccgaatctgctcactttcatggactttccaccagctatccggcaatcactctactccactaacttgattgagaactttaacaagcatctcaagcgcaccacccaccacaaagaacaatttccaacggaagattcactggatcgattcctggtttctcagtttaatgcttataacgagaagtctctgaagcggatccaccgaggctttaaaggactccaggacaccttggaagcatcatttatttaagttagttacatattatatgtacgaaggcatttcatttacacaagatttttgacgctaccgcttgttatggcttctccaatcaggccaatatggtcacacgcgtctaccagctgattgcctagattatctaccacaataacgtcacgatggtaggcttatttgttaaaacaaataataaatttaaatcatgagctatcacaggcttatcattttaaacaatttaagatgagagtttgatcctggctcaggacgaacgctggcggcgtgcctaatacatgcaagtcgaacgcgtctccgttaatgattttaggtgcttgcacttgaaagatttaacattgagacgagtggcgaactggtgagtaacacgtgggtaacctgcccttgaagtaggggataacacttggaaacaggtgctaataccgtataacaaccaaaaccacctggttttggtttaaaagacggcttcggctgtcactttaggatggacccgcggcgtattagcttgttggtaaggtaacggcctaccaaggcgatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgtcagagtaactgttgacatcttgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggcgtttaccaactacagtatcaatctcaaagtggccaaattccttgcgtttgtcgacccttttaggacgttcctcaatacttttaccagctaaacgtcgatgcttgtttgaccagtgatgtttagtacgacggttagccttctccaccaaatcaagattacggatctctaacaattgcgcatcgatatagttgtagagagttttcgtacaaaccatctccgtgcgcttaaacagatgttgttggtgggcgaagccgactgctgcatcaggtgaccaatcatcttggtggaaatgatcatcaaagtaagccagaaagttagtaacaaatttaaattttagaggtcgatgacagcgttgtcgattcgtttgataccgaacttgggccgtatcaggcgcataaacgctaaagtactgttctttaccattgagtttctttacctgttgaatgcggccacgcttaagctcattattaatagtttgatgacagacaccaatttcagcggcaatttgacgagcagatttgcctgcagaaagtaagccagcaattctgcctcgctcaatttgagttaaatgatgaccctttacgtgagatgtgataagctgttcttgcaccaagacgaaaacctctttcattgtttagtgtgggaacttcaatgatacctgattttttcgtcttggtgtcttttatttggccacttttaaaaggtggctaacttgattataaaattcgcgattggggtttatctatcaacggacaaagtcctttcgcttaataacctcatcttgccttttatctaaaaagtaggtatataaagcgtcatatactttgcgcttttctggatctggctcatgtaatgacttatcaagtaaatcttttaaatcagtttctttggcaatttcaaaaaagtcattaattgtgattgtatctttcatgttcatcacacttccaagttattaatttatttaatctgataagccattagtcctcatctggatcattgagccaatcagcgacttctttagcgtctttgaactctgttactggtgtctctttggtagcctttaaaaggcttaaattagctctttcggcttcgctcagggctggtttaaacggtaatgctgcgtcagctacgatccgcttataaaacatattgatcgcggtagttgggtttagacctaactggcttaaaacggcttcggtattatctgccaattctttgtcaatctggacttgtacgcgtttcttttccttaactgccatgattttctcgcccccctttattactactcacattatactaatctttgagtaccatctcaattagcctgcttctttaaaagttgtgaatttaagtttgctgtcctttccgcaatggcacttatacaacgttcctaaagtgcccgtaagcgcattttaaaactcgtttaatataattatgctctatctgtttaaaacagctaagccggcccgcagcgccagaaaacagccccaaagcccaccgcactaatccgcccacttcttccgcccactgctcgccgcccagaccagctagcacactcaaactcaggtcaaaacgctcgccctagcccccgctcccaaacgtccacaaccacacccccgtcagagagaaaaagtggttttcgacctcttcgtgtgacatcgattttgttgacatggtctccgacttcattggctcatatcgtatcttccacgccagctattgcagttttggtcagtggtttccccatcagcaaagctacatctagtacctccccgaatatggtggcagtacctgcctgacggaacaaagtcaaaatcacttctgaccaaatattgactgaatctactactttactatgtatcacctgcatatttcctccaaaaccattttggtcaaatttgttcctggggctatcgcccccgtagaattcgacccgctacatctcgacgcgctgattccaacgctcccattggctagggcgtagctgccctgtagcgcgagatataggcctgtgtttccggcagtataatacatccacctcaggattcgaacccgatcggttgcggccatatctagcagaaagcaccgtttcccgtccgatcaactgtagttaagctgctaagagcctgaccgagtagtgtagtgggagaccatatgcgaaactcaggtgctgcaatctgtggttcttaaaaccaagtcatagacttgttgctgtaatttaggcaagttggctagtttctctttcgtcggcacgactttagtcatgataatggcgtagtgttcttcaactttttttccattaacataacgcttatttggcgtggtattggttaaagcgacttgcttagagactaaccccagatacttcgtcagattagccactaaatactcaaattcttcatcagtgatataagcacaatcggtgcggggataactgagtagtttgtcttcgtataagctttgaatagccgctaaggtttggctggcgctggcgtgataacgtttattcatggcactttggagactagatagcgagaatagttggggactagcacgctttttgccttgcttttggacgtccttgataaaaccgtcctgtgagcctttctgaacgtgtttagcctgcatgaatgtcattagccctgtttcgtctttaaatcgctgataggggtctaattttgcgacgaatttttgctgattggctaaaatttccgcatttagctcaaaataaggttccggcttaaagtttttgattgcctggtccctttgatagaccatatacaaggttggcgtctgcacgcgaccaatcgagtacaccccacgtaccccgttttgtcttagattaattaaggtactgtttttccaattaaatagcatgcgccgcttatcatctaaactttccaaactaatataagttttcagttcgtggcttaactctttgaccacttttttctcgttaaacgagaagtgtttacttaggctatccaagtggcctcgattaactactttctcctgcatatttttatagccagctttggacttacgatagttcttaacttgttgattaaatgcctttctttcatgccgtttgctattgattccctcgtgttgcattggtgtgtcagccattccctgttccacaaatgatttttcactgatccgatcaggaatgtttttttgctctaaagcctgattgacacttgccgcccaattgtgccgccattcagttattttttcttttttatcccaatcgaccatcagtatttttctactcttagggtacttgctagttccggtatatgttttgttgccattatcatctaaaatatattgctttttgctcttaattccccatgttccatctgaattaaacggccgattagttaacatcacatgagcgtgcggattatctgggtggtcgcgatgaattgccacgtcggctaccatgccctcatcaacaaaattttcttgcacatatcttaattaaggtactgtttttccaattaaatagcatgcgccgcttatcatctaagttctccaaactgatataagttttcagttcatggcttagctctttaactacccgtttttcattaaacgagaagtgtttacttaggctatctaaatgacctctattgattgctttttcttggttatttttataactggccttggccttgcgatagtccttaacttgttgattaaattcttttctttcatgccgcttactattgattccctcatgttgagttggaacttcatctattccttgattttcaaaggatttttcgctgatccgatcgggaatatttttttgctctaaaacttgattgacactaaccgcccaattgtgccgccattcagttattttttcttttttatcccaatcaaccaaccaaatttttcggtttcttacattccctgcaggggtcttagttttattaccatgactatctaaaatgtattcggtttttgttttctgtccccaagtaccatcggggttaaatgggcgattggttaacatcacatgagcgtgcggattatctgggtggtcgcgatgaattgccacgtcggctaccatgccctcatcaacaaaattttcttgcacatattcggggtcgtttctttttgcggtgtttgcagattcgcttgaacttggtcgccttggtgaacgatcggtagggtggctgcctcttgctgctcggttttggtttcatcaaatagaacttgccaaccttgcttagttgggaccttaccggttgctttaaaattagcgtcaccaacttgggtaataatggtagtttcctcgtactcgtaaggatcagcaaacatcgctaatgtggttcttaaaaccaagtcatagacttgttgctgtaatttaggcaagctggctagtttctctttcgtcggcacgactttagtcatgataatggcatagtgttcttcaacctttttcccattaacatagcgtttattcggggtggtattggttaaagcgacttgcttagagactaaccccagatacttcgtcagattagccactaaataatcaaattcttcatcagtgatgtaagcacaatccgttcggggataactaaggaacttggcttcgtataaactctgaatggccgctaaggtttgactggcgctggcgtgataacgtttattcatggcactttggagactagatagcgagaatagttggggactagcacgcttcttgccttgcttttggacgtaaaatatattgaacaacttgttggatatgttcatcagtctcaaagtcagccggagttaaatacgtttcttccaagtccttgactgacatcgcttgaatcttggcttgaatttttgcttcatcagctgtactcagcaggcggccttgcttatcgcgacgtgctttgacgcgctgggtttctttctcgagggcccgggttattaacgtatctttgccaattgttgttacatgttcgacgttaaacggtaacacggcttggtcctctaaggcatctcgcaagttataaacgtgacagactttaccaaatagctcctcagtcgtgaccgctagatcacccttgaactgtttcttattttcattaaagatgggggtgccggtgtaaccataccagttactattgataaacgctgctcgaatttccttttgcatcttaccaaactgcgaccggtgggcttcgtcaacaaagaagatcacccgttgctttaaagtcttactaaagcgggattgcttaccggttgccagctgggcttgcgtttttttgaccgcccgatggagcttttgaatcgaggtgaccaagaccttaccgtcattttgttgcaatttacgcattaaatcaccggtggcggatgccgaataccagcggtcacgatgtggccgaaagactaaattgaatgacaaattaaggcaaataattttaaaccatttacggctaagttggtcaccagaaatgatagctcacgaatttaaactagcgactaaatcaatttataattggttaaatcaaggaaaaattgagttttctttaaatgatttgcctgaacatggcgtgcgccaacggcgtaaccttgaccaacgttctaaatataatcaatcattaggacggtcaattgaacagcgtcccatgatgattaatcaacgtaatcgcatcggcgattttgaactagatacagtcgttggtcctcgtgggcatagtaaggcagttttattaaccttaatcgatcgcaaatcacgtttcctttgggcctaccgattaaaaaaccggacagcagtaactgttaatgaagccctaactaagtttctagcaacttttaatggcccggtgcatagttttacggtggaccgtggcactgagtttagcggtctagtatcacttgaagcacaatacggtattaagacctattactgccatgcttatacgccagctgagcgcggcagtaatgaacgatttaatcggaacttacgaggtgcaaaagcagttacaaaattttgcagatcaaaacccagaagtaaagcctaagaagctgtctaaaatctcttaagtaatagtgctaaaaacgctaaaacgaccatttgcagactggtggttaattgacgctcacaatttttccagagccgacgatattttttcaaccagctaaacgagcgttcaatgatccagcgttgtggcaacacttcaaatttatgtaactcatttcgtttggcgacttgggtggtcgcttttaaattaagctggacatccatggcaaaattgcggccactgtaaccaccatcaaccaatacgctttgaacctggcgtaaatgcatggcatgtaaagcgatcattgcactggccccgtcacggtcagaaacattggcccgcgttaaatgaatggcttgcgggaagtcgttgatatccactgctagatgccgcttaattccggaaattttctcaccggcatcatagcccttattctcggcagtttcggtatttttaacactctgagcgtcaacgataataaaggaagttaaagctgaacgtccttggtaagttcgccgagcaatgacaattttttttataaagaaaagctttgcgtcaacgtaagtttcgccagttcgataatcaaaaagtgattttctgaatttttcgagtcgtgtttctaggtcaaacttggcattgtagccatgttcactgggtgtaatgggactaagcaggtaattactgatagcaatagcgtttttagtgatggtgctaaaatctgggtgcgtatcaattaagatatagtcatagtcggtcaagcttaatgaatcggagttgtttttaaaccacatgaacaacatcatttctttgttactgttattttctagataacttcctaaaacatctaggtctataaaaccggctattaaatctagattcggtccgacactgtcaatttttactttttgagcagtgtcattttctttaaacgcttcagcgatggtattgtttcgtcgtgtcttttcaaaaacggttgttaaattgcactgatggtctaaatcgattaatagaaccttcttaccatgtttggctaaccaatcaccataatttaaagtcaaggttgttttaccaacaccacccttgatagcagtaaaagtaataatcttcatcttgattgagaacggtatcgatttagaagatgaagatgaactacaggaaatttatttccacttcacctctgctcacaatcgcttctagtgacattagctgaaataggagtctaacacggacttcgtaatctttttttcaccaatttcaacaacttttcttttcttttcttttcttttcttttcttttcttttcttttcacaagggtttttaagtttgacttttcccttatctagtttatcttgtgccacttagtgtgcctactagtgttttttatgctggagagtatgtatcttgtatattattagtagataacacattatgatggaaaaaaaaaaaaaacacatgagcattacccgattaggaagattaagcgagttaagaccgaaggcaaaaaggcaaatgaagagcgaacgcctctgaccccgacaagagggcagaaaagtcaaatgaactccgaaagcctacgggttccgataggagcgcggggaaggctgaaggcgagaacgtgcgtcgctaaactgagataaggaaagctcaggatccaaaaaggggacgtagccacttgaagtataaattttctggataagtaatattttggtttatccaaggaaaatgcctcaaatcgttcttaaaaacttgtcccttctctcttgcataaacagaggtaaacttttcgctattatcatagatcatgaccttatcagatttaaaggccactaatggcaaattatgtttggattgctgataacgtttcttgatcgttgctactggaacaccgtggccacctttttgtacccgttcgttgaccctttggatagctaaattttcatctcgcaaagcaacatataataaagtcacttcaaagccatttttgtgagctttgtcaatcaaattgagttgagctttgcctctacctgccagtgttgtttctacgtgaatactttgctggtgatctaaagcatagtgtagttgtttgatttcttctttcatggcttttaagttgtcactatctttatgccaatcgccacccatttgtcttaaaagttcatcagcgttaatccgttttgttttgtcaaacaagatgggaaatgtatcgtatagcgtactttttcctgctccgttaataccagcaacaattatatacccatcacaaaaaagttattgacgggaacaccaacgatttcagaacgggattttttggactggtgtcaggcgcgattggcgcaatggtctaggagtttaggcggttaaattcacaaagtgagtttactgattttttggggatttttcatctagaccactcctctcccgtcaaatttcacaaaggacaaataacggatcgttgttttatcagggagtgagggggtcacttgggataagccgccttatgtgaagtagaaattggtatactaaaaaaggctcccggtttaacactggaggccttttttctaggttacatattttgaggatgaatgtttttatcttctgtagcttttacttgggtgctgtaacatgatgaatactgcttagtttttggtgccgtaccccgcaacagatgcgtcgcttcgttggtattatcttaaatgctaagtaccgagttgagaaggatcgtaaagatattggcgtcataatctcactggatgacgaagaacttaaatctttaatgactaaagccttgagacgttactttaacgccctagcacgctgttggtgaagatgtcactaagcaattattgacgattaaccaacaagaaagttcactaaaaaaagcagatgaactcttaaataaagtagttgatcgcacgactaaaaaactttatccagagcttgattttgaacagacaaccgcggctgaacgacgggaattgattaaagaaactaatagtgaacaaacgattttcaaaggcagtgaattaaacgaacgtttaatgaatattcgtgatgatttattggcccgacaattattgacctttaccaaacggccatacgttggctggaagttattaatgcaacaagaaaaggaagtcaaaatcaagcttaaatatacgctgatgattcatgatgatagcttagaaagtctagaacacgttgatcaaggtctactagaaaagtattcaccaaccgagcagcaaaagattactcgagcagtcaaagacctacgggcaatcatggccgttaagcaagtcattaaaacgcaataccatgaagtattaaaaagggcctttcccaaaggcgatttagatggattgccattctaaggttcatcatagaaaagaagaattacactagcctcaaacaagaaatcaatgatgttttggtcgctgctagtttggattccttggacctgataatatacctacggtgtctttttagctcggttatgtatccagcatgatttatagctggagaaaacgatccagatatttaaaatagataaagaaaattcagaaatcacttttaaagttggcggtgtctgtgtttcgaataagtaactaaatgtgacaacttatcgttacttgaatatttttgattagtttgctagcatataagaagtattattaaaacatgaataaataaatcagttgacgtaagctcaaggtgttctctttcaggggtgtgtaagaggtatctgggtttacgttttttgtatgaggaggtttttgtttggaatttttaggtaccttggtgatcatcttgattacaactagtctatttggccatctagcctctagggttggtatcccagcagtgatcggtcaattatttgttggaattattcttggccctgcgttgttgaattgggttcaactccggcaggcggactcgaaccgtcgacaacctgattaacagtcaggggctctaccaactgagctatgccggaatattcgcatggcaacgtcctaccctcgcagggagcgatcccccaactactctcggcgctaagaagcttaacttctgtgttcgacatgggaacaggtgtatccttctcgctatcgccaccacacttctccgatccaccttcgtggctcgtgtgaaagaaatttattctctcaaaactaaataatatcgaatccttctcttcaagaacaccactttgtggttaagtcctcgaccgattagtattggtccgctccatgtatcactacacttccactcccaacctatctacctgatcatctctcaggggtcttacttccataaatggaatgggaaatctcatcttgaggcgagtttcacacttagatgctttcagcgtttatctcatccatacgtagctacccagcgatgctcctggcggaacaactggtacaccagcggtatgtccatcccggtcctctcgtactaaggacagaccgccaattaaacaaaaaagctttattgaaatgatccggttcggcattcgcaaaatacgccgtactatccggcgtcataatcacaaacatttgcaacagcgagtaaattcccgtatatttaccttcctgtgcgtatttttcaatttgattaaaagcctggttaagttcgaccgtggctttttttagttccaattgaattaagggtaacccattaatcaatagggttacgtcaaaacggcgatcaggatcgacatcttgagtaccagctaaccgtggtcgcactgcttgccgtaccacttcataactagatttaccgccagcaacgtccgctttccaaaacaactcgagcgtaaccgtgcccagcttagcatcatcacgttcaacttcaactttgccaatgccattttcggcggctagtaacttagctgcttcgtaaggtgtccggacctcaatcgcccgtttaacctgattaaattcggtatcagttagagcctgtgagcctttctgaacgtttttagcttgcatgaatgttattagccctgtttcgtctttaaatcgctgatagggggctaattttgcgacgaatttttgctgattagcaagaatttcagcatttagttcaaaatagggttccggcttaaagtgtttgattgcctggtctctttgatagaccatacacaaggctggcagctatacgtaactaatcgagcacgctctacgtaccaaatttttctcaatataaaatacattacgggctaccattcataccaattaaccagtcgctaattttgtgattacaagtgcatgcccccatcttcatgccggttccgggtttgatgttgccgctgctttttcgtcatttcccactcagtctcctttaaaccttgcgcctgtttttgccgttggtaatcttcatcacgagcatatagaacagtcatgatcgcatcactaaaggccgtctttaagtaatagtcccaggaaataaacgatcatgcgatccgactcgaattccaattaagactagttcatctgtatcaatcgtataaacaaccagaacatcgttagtttcgcttggtgttttgtttttcggggtgtctcgtaaatgaaattcattataaccgctcattcgccgattaagctcatgatcttcaaattctggcggtaattgttgctgctcaagcaacaggtcaatggctgctcgaacttcatcaataatagatttgtctaaactggctaaccgttttaaatcagcattaaaggttgcacgtggtttaaatcttagttttttcattatttaaactgaccccaataatcatcatttgattcaacaatttcatcatcaggtaaaacatgtcgtttaattaactgatcacgcgcaattgcatattctaacgaaccttctttcgcttttaatgctctttctagccagtccattttttcttgtgaaacgatggcctctaagaagatggccgcatattgtgaagccagtcgacgttgctggaaagcttgaacctgttcattgacggctttagtcatgttggaaaccgtggctttggagtagtgagcaccgtacattttctcaatgagttcggcaatttcagcagtggtaattcccttggtatacaactgaatgaccgttgtttctaaattatcactgtgccgaccgtaggctggcaaggtatgattttcaaaccggccattgcgatctcgaggaatggttaagttaagttggccgtacttcgtatcaaacgagcgctcataactgccgttgcggttattaccagtgttaatcccagcgtatgagtagcgttcgtaacccaaaaactctgccaattcggtttgaagcagctggttaatcgcaatttcgaggtggtgacgaaaaacttcgtccaaatcttgcttttgggctagtgcagcgataatttctgtggtaagttctttgtatttttctggatcggaactttttaattacttatccaaaatgcactaacctctattagttttatttccatatatctgttatttcactcctatttaaattttttcttcactgccctgcttatttaatgagaaatttatctatacacactgaatttctttcgataccgaataaaggttgtccgcttaatcccagtatttcgagccacatccacatcgctcataccattttgataaagtttaaaggcatgtaacaaacggggatcatcttcagcgtattgaggtttgcgaccatgatatttgccctgctgtttggctagggaaatcccttgttgctgacgctcaatgatccgcttacgttcactttcagcttggtatttataaagttcaataatgaggttggtcatgagttgacgtaaattggggtcagcaatccctgtcatggacggtaaattcaacacatctagggtggcacccttatcctatacaacgaactcaaaaattatttgaataacaatactgatattaaagtcagtgaaaagagattgtcagaacttggtggcgctaaaggctattttcaacccagcactaatgaaatcgtcatcggtagcgatgagcccgacaatgccttgaaactggagacgttatatcatgaatacgcccatagccaattacacggcttaacgtcagaatttaaagaccggccacgagcctatcaggaaacccaagccgaagcggttgcgtacgttgccatgcaaaatattggcgttgataccagcaactactcactcggttacgtggccacctgggctaaagataaagccgtgatccatagtgctttaagtgagatccagcaagtgagcaacaaagtgattgagcttagcgatggcttaaccaaacaattaggcttacaagaagacccaaaagagcctgagcatgatctaaaaaagctatcagcccattctatacaacgaactcaaaaattatttgaataacaatactgatattaaagtcagtgaaaagagattgtcagaacttggtggcgctaaaggctattttcaaccccgcactaatgaaatcgtcattggtggcgatgagcccgacaatgctttgaaactaaagacgttatatcacgaatatgcgcatagccagctacacggcctaaaatcagcctttaaagatcgcccgcgagcctatcaagaaacgcaagccgaagcggtcgcatatgttgccatgcaaaatattggcgttgataccagcaactactcactcggttacgtggccacctgggccaaagataaagccgtaatccatagcgctttaagtgagatccagcaagtgagcaacaaagtgattgaacttagcgatggcttaaccaaacaattaggcttacaagaagccccaaaagagcctgcgcatgatctaaaaaagctatcagcccagaagtggacatgaaagtgtattattgaccttcacggaacgtaaaactcgttatgatattgttcgcttgattgaaggcaaagatgctgattcggtatcgtatgcacttaagggaatttgtgctgaatttggtgatcttattaaatctgttactgctgacaacggaacggagttcacagccttgaatgcagtcttagacggtgtagctgacatctattatgcccatccgtatagttcctttgaaagagcaaccaatgaaactcataaccgcatgattagacgatatttacctaagggacactcattagatacgattggtcccaagacggtttcaatggttgaaagtcgtcttaaccaattaccgcgacgtatcttgaagtatcaaaccccaaaagaagcttttcaaattgaagcagcacgtattcgtaaatcatgtagtgcgtagctattatcttgaccttcaatagatattctgacttgcccttttaatcttttgattaagctgttttaatttggcttcttgtttttctaagttactttgagacataatgatccctccaatcgtattaaaaataatcaccgacactatatcatacagagaacgttaagtcaaagtatgaaagttgaaatagcgaagcggaagtcatacactataagtaaatttaggggaatcagcaggccgagtgaaatgaggtcaatgcgcacttacacgtcatctttgatgacgttgtgctaaacccattaaaacctgtattagaagtcgccaatggcgacaacaaagtcaagcccatagaatcaaaggaagaaggtgactaacatggcaatctttcatatgagttttagtaatattagtgctggaaaaggacgaagtgcgattgccagtgcggcttatcgaagtggtgaaaaattatttgatgataaagaaggtcgccactatttctatgctcggtcagtctgaatattgtctatagctaatcaaatctaaaaatagttcataaataatcaccattacctagcaatattacaggtatgcttggtgttcaaatccttaacggtactaaccatattatccaaattaggtggatagcttgcgaaagatcactaatatccatgaataaatgctattttttactagttcatattccttattttaagcaatttcagtatgcttaatactataggcatcggcaatgataaatgaggttgacaacaactgcccattgatcaatttggcagctaacaattttaattaacaatagctttgaattattgaaaaatcataaaggaagatgtacggtttaactttagatataaagatttcacaagaaactacatatgaagtttaatttaccgagacttagttcgtctacgaaggtttcctgaattgatattgataattctaaatcatttttaacaaacaattctttgacttggtgtcttgagcatcctcaaccagttcaacaattttgccaaacgtggtgtcgtcgccaaccttggttgcccgaactttaagtgttccgttgtctaagatggtgccagagaatacctgattgccagtgcccttagtgactagttttgattcaccagtaatactggcttcgttgatgtgaccggatccatccacaatttccccgtcaaccggaatctgaccgccggctttgaccaagacgacgtcgtcaacgtcgacaaagtcaacatccgtctcctcagtgttgccgtcatcatctacaatcattgcggtagtcggtgccatttccgtcaagcctttaattgagtggcgggttttggccaacgttttgtcttccaaaaacgtcccaaataagaacaagaaagtgacgattgctgattcattgtactcgccaatgatgaaagcgccaatcacagcaataacgattaagaacagtcagattgagaaaatccaaaaacagttaaaagagcaacaagctaaggacgatcaataccgaaaatcccagctggcacattatcaaccattgaactacaagccagttagtccagaatattacctaaagacggcctttagtgacgcaatcatggccgctctatatgcccgtgatgaagattaccaacggcaaagacaggcgcaaggtttaaaagaggccgagtgggaaatgacgaaaaagcagcggcaacatcaaacccggaaccggcatgaagattggggcatgcacttgtaatcacaaaattagcgactggttaattgatatgaatggtagcccataatgtattttatattgagaaaaatttggtacgtagagcgtgctcgattagttacgtatagctgccagccttgtgtatggtttatcaaagagaccaggtaaacaaaaccatcaccaagtgattagaactccaatattttgttcaccaacaacagttctaatatgatgtcaagtatcaacttattaaaaaaagagtacactaaacagtgatagctttttgacagaaaaaagctgtcataaatatcaactatactggtatttaaatagtctgcttaatgggaagttcttgcgtaattataaatttggtttgtgcggaccaaattcataatcgtcctatcaagcctgttcacacaagcaatcatggcaaccatatccggtttaggatgtggtcctttttttaacttatagtagtaatccacaatgtgattatcaatgcgtgctttatttctaagcatggatctaatcatttcaaacataatataacgggcactactttggcctctccgattaatccggtcagcttctttgagccctccggattgggttcgtcgtagatctattcctgcgtggcaacgtcctaccctcgcagggggcgatcccccaactactcttggcgtgcagaagcttaacttctgtgttcggcatgggaacaggtgtatccttctggctatcgccaccacactatttttccttgaaagaacttcgttctctcaaaactagctaatattaattttctgcccttgaacaccatttctacttggttaagtcctcgaccgattagtattggtccgctccgtacatcactgcacttccacttccaacctatctacctgatcatctctcaggggtcttacttccatataggaatgggaaatctcatcttgaggtaagtttcacacttagatgctttcagcgtttatctcatccatacgtagctacccagcggtgcgcctggcggcgcaactggtacaccagcggtatgtccatcccggtcctctcgtactaaggacagccgccattcagttattttttcttttttatcccaatcaaccaaccaaatttttcggtttctcacattccctgcaggggtcttagttttattaccatgactatctaaaatgtattcggtttttgttttctggccccaagtaccatcggggttaaatgggcgattggttaacatcacatgtgcgtgcggattgtctgagtgatcgcgatgaattgctacgtcagctaccataccttgatcgacaaaattttcttgcacatattttgtcagtaattctttctgttcggattcacttaattctaccggtaaagccacgttaaattcttttgcataccgtgagtttgatttacgatctttcttttcaacttcattccacaactgctctcgatcactcgcccattctggcgcattttcgggagttaaaataaagctttctggcataattctctagccaactaaaagatcgttcgactacccaacgttggggcatgacttcgaatcgatgcaactcattgcgcttcgcaacctgcacggttgcgtttaaattactggctacatcgagctgaaaattaacgcctgaataaccaccatcaactaagacattttgaacctggcgtaaatgcatggcatgtaaagcgatcatggcactggccccgtctcgatcagagacgttcgctcgcgtcatgtgaatggcctgcggaaagccattgatatcaactgccagatggcgcttaatccccgagattttcttaccagcgtcgtaacctttgttttcagcagtagcggtgtttttgacgctctgagcgtcaacgataataaaggaagttaaagctgaacgtccttggtaagttcgccgagcaatgacaatttttttaaaccgatcgggcataaaaatagtggcggccttcttgattatcaaataatttttcaccacttcgataagcggcactggcaatcgcacttcgtcctttaccagcactaatattactaaaactcatgtgaaatattgccatgtcaatcaccgtcttcctttgattctatgggcttgactttgttgtcgccatcggcgacttctaatacagtttttaatgggtttagcacaacgtcatctttgatgacgtgtaagtgcgcactgacctcgtttcactcggtctgctgattctcctgaatttacttttagtgtatgccttccgcttcgctatttcaacttctatactttgacttaacgtttcctatatgatatagtttcggtgattatttctaatatgattggaggaatcgttatgtctaaaagtaacttagaaaagtaagcaattttctgaatttttaaaggtaaagtccgtagatcattagccatacgagatggggaaattccatgtctaatcaatatgaaaaactagtcgagcagcaagcgcgtttaaaacaaaaaattgagcgggaagattttaaattacggcaatctaaatactatgaaaatcggcaagcccgcaaagcccgttctcgccgactaattcaaaaaggggctttattagaaaagtactttcaagctaataacctctcggtcgaacaaaccgaagaacttttaaaaacatttgccgattacgttaatacccataaaccgaataaactcaaaaacgatcaacctaataactaggccgatcgtttttattttctggatcatttttaggattttcttctgggttttgatctgcaaaattttgtaactgcttttgcaccctagtcttagccgggagtgatttactggctagcttcagcacatgagtcgctagtccgtgaccgatggcgtggttggttgataccactggagtggtggccgtacaagtgctatggcagttactacaacgccagcgttgcttgtttagctctagaattacgggccggtccatgggtcctgcaatgtggacatgagtgagcttgtgtccgttagggtgcaacgtattgtatccacagctgggacagcgcctgagtgtgtaggtaagctctgcctggatgaccaaatactttttgcgacccgagccccgaccatgaaattcctcacgagtaccgaacacctgaatgtttgtgtctgtaattcccagtaatttaagtgtattatctagttgagacatctattcctaccccgcttatcttgagtttttaatcaagcagggcgttaaagatgtgctgttgtttgtggccgatgggttagttggtttggatgaaggcttgaattggcatttccctaaagccaaacgacaacgttgcctggttcatgttgggcggaatctgatgaacaaatcagatttgcttatgagctgcgaaaacaaggcatgacctacaagatgattgaacgaaagacggggattagtaaacgcacgcagcagcgacggtttaagttaattgagaaaccaagtgatacttctaaaatctaagacaggtgaaagatcatgaaaaaggatatttggtagattgcaaatttaatccgaatttttggacaaatttgtcagcataacctgatacggtgtttgccagtcgagtattttaggcggtcgctggttaatttggagtaacgtcccctagcagcacttgaactaattaatcaacgaccattaaaaatacatcatcaacagactgccattgaaagattccgggcttgttcggattaaacttgtaatttgccaactgaaaaattaattttaccttgacccagttacctggtgtgcatcaaataagtagtgattgagcaccaaacgaaaagatttattagattaataagtaaagcaaacccctgagttggagtaaatccaaactcaggggttttactggtctaactgtttttcagaccattctctgtaaactgcatctggccactagggtataccctattggccgtttttgtttttgtgctatactaggaaatacagatgttcattagaactgtccaaaaagggagagctagaaatggctaaaatcggttatgctcgtgttggccatgattgcccgtaggtctttgactgcgcgagtaatcttttgctgttcggttggtgaatatttctctagtaacccttgatcgacgtgttctagactttctaagttatcgtcatgaatcatcagcgtatatttcagttcgattttgacttccttttcttgttgcattaataactgccagctggtatacggccgtttggtaaaggtcaataattgtcgggtcaataaatcatcacgaatattcattaaacgttcgtttaattcactgcctttgaaaatcgtttgttcactattagtttctttaatcaattcccgtcgttcagccgcggttatctgttcaaaatcaagctctggataaagttttttagtcgtgcgatcaactactttatttaagagttcatctgcttttttttttgcagatcaaaacccagaagtaaagcctaaaaatgatccagaaaataaaaacgatcggcctagttattaggttgatcgttttttaatttatccggtttatgggcgttaacatagtcagcaaatatttttaaaagttcttcggtttgttcgaccgagaggttattagcttggaagtatttttctagcaaagctcctttttgaattaatcggcgagaacgggctttgcgggcttgccgattttcatagtatttagattgtcgtaatttaaaatcttcccgctcaattttttgttttaaacgcgcttgctgatcgactagtttttcatattgattagacatggaatttccccatctcgtatggctaatgatcgacggactttacctttaaaaattcagaaaattgcttgtagcatagatctacgacgaatccaatccggagggttcaaagaagctgaccggattaaccggagaggtcaaagtagtgcccgttatattatgtttgaaatgattagatccatgcttagaaataaagcacgcattgataatcacattgtggattactactataagctaaaaaaaggaccacaccctaaaccggatatggttgccatgattgcttgtgtgaataggcttgataggacgattatgaatttggtccgcacaaaccaaatttataattacgcaagaacttcccattaagcagactatttaaataccagtatatttgatatttatgacagcttttttctgtcaaaaagctatcactgtttagtgtactcttttttaaataagttgatacttgacatcatattagactgcgcgactatttgaacgagcaatataaacggtttcatcttcgtcattaacttgatctaaatatttttttaggttagcgcgaaaatcgctctgtgttagtgctaatgtcatatttaccaccctttcattgtacttaatattgtactttaatttgtactaaaaatcaattttttaaggagctaaaactatgcaacaagttgtcttacccatcaaagattcaaacgttctcaaagaggttcaagataccttactcaacaactttaaagctggccggcgtaactatacagtttttcaagttggcaaagcgacactgttgcgagtcagtgatgtcatgcgcttaaaacaaaccgatatttttaatccggacggttctattaaacaaaatgcgtttattcacctaatcaatatgaaaaactagttgagcaacaagcgcgtttaaaacaaaaaattgagcgagaagattttaaattacggcaatctaaatactacgtaaatcggcaagcccgcaaagcccgttctcgccgattaattcaaaaaggggctttgctcgaaaaatactttcaagctgataatctcacggttgaacaaaccgaagaacttttaaaaatatttgccaattacgttaatgcccataaaccgaataaatttaaagacgatcagcctaataactaggccgatcgtttttattttctggatcatttttgggcttgatttctgggttctgatccgcaaaatcttttaactgtttttgaattcttttactagttttgtctttaactgatttaagagttgtctcaggaatcagcttacatccattaggtagtgaagacttttttgaaccacctttaattaacgaaaaacaagaacaatcctttttacaaaaaatcttggctgatccacaaacgacgattactgataaagcattgactgtcatgtatcataatatgcgcaacaaatcttttgggacgggaacaaaaggacggcgactttaagtgctaataaaattatgattgacggtggtgcaggcttaatcaatgtgccgttagataagtgggatcaatggaacgaactaattgccaattattatcgaactaatgacatagctaaaattaaacggtggacatatgacaatggcattcaaggattacaaattagagcaaacttagcattttgggcttcgttaatggcaatatcgtcattggcagcataggcactaaagttgctggttgtctgttcgtctaaatcccgccggtcaactaagaagatgaccttatcgacaccgggatcttgcgcagctaatttagcggttttatatgaggtgagtgtcttaccagaacccgtggtatgccaaacaaagccatcttgatggtcatgaattcgatgcatgacagcctcaatcgcataaatctgataaggccgtaagagaattaagctctgacgttcttggtcgatgaccgtatattcactgaccattttgtgggccatgggaatattaaggacttggcgcgtaaacgctaagccgttttccacggggtgattatcccgcgtggcattttcgaattttgactttttcgcgctcgggattttctcgcggcggctcagcacccgtgcacacctccggcgccggactcgaactccgaactctggcggctcaactccgaaaccggcgaaatcctccgcgcgcccaatcctgctgagcccccctcgggcatatcggccccgccccagggaagtcgcgtcgccccgtgtacgtaagcaacttttcggctccccccgagcacgccccggcgcccgcgaccacacacttgttgcgcgcacctcgccactataagccatctgacccgatctcacgctacagtggggctctcgccaaaccgacaacggctatcgcttctgctacactaggcgatgccgattctgctgtgttcaaaaggaacaaataaaaaagccgccctgcgtaactttggctaggttacagggtgactcaactatcattttttaactaatgccaccgcctttgaagcggcttgcgtgggaagtcctgttttcggcggggcttccttttctgtttccattatagcatgtcctttaaaagctggctaacgtttcagactttgatcgtattcaggatcaggttgtttgatttccggattttcttcagcaaatgctttcagttgtttttgagttcgatcactaatttcttggtgcacatcgtttaactgattttttaattgcgctttttgttgtggactagttgcttgctgaacttgttgttgcaagccttgataggacttattaagatcagccatgattgttcgcaaatctttgactgcgcgagtaatcttttgctgctcggttggtgaatacttttctagtagaccttgatcaacgtgttctagactttctaagctatcatcatgaatcatcagcgtatatttaagctcgattttgacttccttttcttgttgcattaataacttccagccaacgtatggccgtttggtaaaggtcaataattgttgggtcaacaaatcatcacgaatgttcattaaacgttcgtttaattcactacccttgaaaactgtttgttcgctatcggtttccttaattaattctcgtctttcagcttgcgtggtctgttcaaaattaagctctggataaagttttttcgttacgtgatgcaaagttaattgagtatttgcgatttttttctagttaacaaactcaaaataacgcggtgttctcggttgaaattatataaatacaatttcaaaaaaattattacagaaaattaatattatctagttttcaaagaaccaagtctgacactctcgtgtcaatggagaatagcgggatcgaaccgctgaccccctgcttgcaaagcaggtgctctcccatctgagctaattccccatgttactccggtgatagctaactatcaggccgtggatgggcctaaatggactcgaaccatcgacctcacgcttatcaggcgtgcgctctaaccagctgagctataggcccaaaaagcgtaaccacttaaacacagcagaatcggcatcgcctagtgtagcagaagcgatagccgttgtcggtttggcgagagccccagtgtagcgtgagatcgggtcagatggcttatagtggcgaggggcgcgcaacaagtgtgtggtcgcgggcgccggggcgtgctcggggggagccgaaaagttgcttacgtacacggggcgacgcgacttccctggggcgcggccgatatgcccgaggggggctcagcggaattgggcgcgcggaggatttcgccggtttcggagctgagccgccagagttcggagttcgagtccggcgccggaggtgtgcacgggtgctgagccgccgcgagaaaatcccgagcgcgaaaagctgacaagtaattcgatgctgatcgttttaaaccggagtgctgaaaccgcccgaagaacgatcggcacagctgagataattgaagcggcgataaatgaaaccgtgtagatcatatcgctgtcaacaactttacccaagagacctacgccaattaatattgccgttatcaatgtaatttgatttgtgtgttgattaatatatctttgaaatttcataatccccgctccatttcttaattgatgtctttagtatatggtggttcgaccgataaagaattgacgtggatcaagtttgaaatttttgtttgggtaattaatggcgaatattttggatgtaagctgattcctgagacagcttctttaatcttttgattaagctgttttaatttggcttcttgtttttctaagttactttgagacataacgatacctccaatcatcttaaaataatcaccgacactatatcatacagagaatgttaagtcaaaggataaaagttgaaatagcgaagcggaaggcatacactaaaagtaaattcaggagattcagcagaccgagtgaaacgaggtcaatgcgcacttacacgtcatctttgatgacgttgtgctaaacccattaaaacctgtattagaagtcgccgatggcgacaacaaaatcaaacccataaacccaaataaaggtggtgaccgacatggcaatttttcccaatgcggcgggcgggcgaggcagacgcagagcagccagcgcgcgagtgaaaattctgcaacgtcgacgtcgaaaaagtggacgagggcgaaaaagtgggcgaaggcggaaattggcggaagagcggaagcgcagtcgcccaaaacggattagcgggtgcggctagccgcggtacgcatcggataccgtcggatattccggagagaaatcgacgaattctaggaagcccacagtttataatgttttacttgcaaatagtatttggtcagaaaatgcactctcgcaaacttctttcccgcatagaaggtgttgtagttggactatggggccctttggggcgatcaattgaacagcgtcccatgatgattaatcaacgtaatcgcatcggcgattttgaactagatacagtcgttggtcctcgtgggcatagtaaggcagttttattaactttaatcgatcgcaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttgaatcacaatatggtattaagacctattactgccatgcttatactaatacccgtgaagatgcgggttacccgcgacaggacggaaagaccccatggagctttactgtagcttgatattgagtgtttgtacagcttgtacaggataggtaggagccatagaaaccggaacgctagtttcggtggaggcgttggtgggatactaccctcgctgtatgaaccctctaactcgcgccactaagcgtggcggaagacagtgtcaggtgggcagtttgactggggcggtcgcctcctaaagagtaacggaggcgcccaaaggttctctcagaatggttggaaatcattcaatgagtgtaaaggcagaagaccttctgcctttacactcgttgaatgatttccaaccattctgagggaacctttgggcgcctccgttactgtttgggaggcgaccgccccagtcaaactgcctacctgacactgtctcccgccacgctaagtggcgcgggttagagtgttcacacagcgagggtagtatcccaccaacgcctctgccgaaactagcgttccggcttcaatggctcctacctatcctgtacaagctgtgtcaacacccaatatcaagctacagtaaagctccatggggtctttccgtcctgtcgcgggtaacctgcttcttcacaggtatcttccaacgctaattattgaaatatagcactgcaaaatagtaagcctaaacacgaagaaaagcaactatgccatatacatcataatgaaatcactttaaagaagctcataatttacaatctaccttaacattaaatttctttcgataccttataaaggttgtccgtttaattcctgtattacgggcaacatcgacatcactcatgcctgcctgataaagtttaaaagcatgttgcaagcggggatcgtcttgggtgtattggggtttacgcccatgatatttaccctgctgcttagctaaggcaatcccttgcacctccttcatctagcttaattatatcattagcagacaaacaaataaacaatttattaaataattaattcaatggctttggccggcttaatcacgtacttcggcaatatcaacatcactcattctcggctgataaggcttaaactagtctgatatgcttaacacttctttactgtatattgatttaagtgtacaccgtcaggcttttttactgtctaaatttaactagcaccacgcgtatgagtattataattgggtagattgtaaaattaatccgaacgctgttcggacaaaaaagatcagcttccttttcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggtaccaccggatcactaagcccgactttcgtccctgctcgacctgtctgtctcgcagtcaagctcgaatattgccatgtcagtcaccgtcttcctttgattctatgggttttgaccttgttgtcgccatcggcgacttctaatacaggattttagcacgatttaccccacaagaatttagtggggtgtaagtgcgcattgacctcgtttcactcggtcttctgattctcttaactttaacttagtgtatgccttccgcttcgctatttcaacttttatactttgacttaacgtttcccttatgatatagtgtcggtgattatttctaatatgattggagggatcgttatgtctcaaagtaacttagaaaaattgtcagtaattctttctgttcggattcacttaattctaccggtaaagccacgttaaactcttttgcataccgtgagtttgatttacgatctttcttttcaacttcattccacaactgctctcgatcactcgcccattcaggtgaattttttggcgtcaaaataaagctttctggcatgatcgatcgggcataaaaatagtggcgaccttccttatcatcaaatagcttttcaccacttcgataagcggcactggcaatcgcacttcgtcctttaccagcactaatattactaaaactcatgtgaacttttttattgcacttcaaacaccattttaaaggaagctgatcttttttgtccgaacagcgttcggattaattttacaatctaccattaaaacacatattggagtcggttatcagatggttcaactagatagttaagaatagaatgcccataatttatggtttcaatcagtatatcgtaaattatgagcttctttaaagtgatttcattatgatgtatatggcatagttgcttttcttcgtgtttaggcttactattttgcagtgctatatttcaataattagcgttgggcttctggtgccgaactccgcaacaaatgcatcgttttattggcattatcttaaatgctaaataccgagttgaaaaggatcatcaagatattggcgtcataatccctctttacgacgaagaactaaaacctttgatgactaaagccttaagacgctactttaacgccctaagaagcaatgagaagcacatcaagaatgttgagaactacttatacggcaccatgcaaaacctatttggcgtttggtggaataaacaagcggcaagagaatatgttgctgaccacttttttctcgttaaacgagaagtgtttacttaggctatctaaatgacctctattgattgctttttcttggctgtttttataactggctttggctttgcgaaagttctttactttttggttaaattcttttctttcatgccgctttctattgattccctcatgttgagttagaacttcatttattccttgatcttcaaaggatttttcactgatccgatccggaatgcttttttgctctaaaacctgattgacactaactgcccaattatgagcacaattggtcggttagtgtaaatcaagttttagagcaaaaaaatattcccgatcggatcagcgaaaaattatttgtggaacagggaatagctgacacaccaatgcaacatgagggaatcaatagcaaacggcatgaaagaaaagcatttaaccaacaagttaagaactatcgcaaggccaaagccagttataaaaacaaccaagaaaaagtaatcaatagaggtcatttagatagcctaagtaaacacttatcgtttaatgaaaaacgggtagtttcctcacctaaagccgtctcaattaacccaaccactaaataatctgtctgtttcgtaacccaattttgtggtttcgccccaaagactttcgccaaactaaaagcttgatcccgattcatggtagttagacgtccggtaaaagcaatctcacaatctcttaaatcaagcattttaaatcatcaactttcttgattctaatgttggttttgacttgacgggttatggttttccattcagtttagagggagtgacgttttgagcgcagaattgttccgtggtattggttaaagcgactggcttagagaccaaacccagatacttcgtcagattagccactaaataatcaaattcttcatcagtgatataagcacaatcggtgcggggataactgagcagtttgtcttcgtataagctttgaatagccgctaaggtttggctggcgctggcgtgataacgtttattcatggcactttggagactagatagcgagaatagttggggactagctcgttttttgccttgcttttggacgtccttgattaaaccggacattttgaacctggcgtaaatgcatggcatgtaaagcgatcattgcactggccccatctcgatcagagacgttcgctcgcgtcatgtaaatggcctgcggaaagccattgatatcaactgccagatggcgcttaatccccgagatttttttaccagcgtcgtaaccttttgttgttgctcgttgtacttggatgtcttaacaaaaagtataaactgtaattattagtaagtatattaggccactagggtataccctattggccttttttggttcaattttacttagggtttaggaaatctcaatccgttagtgtctatttacatcaagttgtaaatcatctagtggaacaaggtattttagaaccacaaatacccacgtattcaacagagcgacaacggaaagtcggcgactttaagtttgttattataaaggaacaaccagcagatttaattgtcaatgataagttaagctcgttagatagaagattgattggcgggcgcatctatttgcagaaaattacggcttcacctacaggtgaggccgtaattttctgcaaatagatgcgtcccccaatcaatcttctatctaacgagcttaactgatcattgacaattaaatctgcgggttgttcctttataatgacaaacttaaagtcgccgactttccgttgtcgctctgttgaatatgtgggtatttgtggctctaaaataccttgttccactagatgatttacaatttgatgtaaatagatactaacggattgagatttcctaaaccctaagtacaattgaatactggtgcgatggtgaccggttttaaatcaattgctaaccaaaataagacggtttattacaatagcaatggtcagatgcaatatggtcagcaacatctaaatggtcactggtatttatttgacaatacaaccggagcaatgcaaactggtttccagaagattgctaatcagcataagaccgtttactatgctaacaatggacaaatgcagtatggtcagcaacatctaaatggtcactggtatttgtttgatcaaaaggaagcgatccagtgaatcttccgttggaaattgttctttgtggtgggtggtgcgcttgagatgcttattaaagttctcaatcaggttagtggagtatagtgattgccggatagctggtggaaagtccatgaaagtgagtaaattcggcattttaagcagatctttgattaatttgggataggtctgatgccagttgttggcgaactcattcagtttcagttcggctgcttcacggttggcggcccgatgaacttggatcggctttgcattcgccaaaaaagagttgtttagtgccatcatgctttaaaacccgttgtaagtgatgattttctaactgatctaagctaagctgtcccgataaataagctagtccttgttgatgttcttggggactgaacacctgtggtggatttgcttgccactgttcaattgtttcagcctgacatggctttaaaacaggatcatagtacatcacggctgtataggcttgttcctgtttaatcattctagtatttatagtaccaatcttatcgaatcatttaacaaaaaatttaagcgacaaacaaagaaacgtgaacaatttcccaatgaagaatctttggaaagaaccttaatgaccgtaattcttgattacaatgacaaatttggtcgacgaacacataaagggttcaacctagttcaagacactttaaaatcaatgttttagttcaaaagtgagaggctttttcatttacacataaaatttgacactctcgcctcacctcacaagggaaaagacagccaccgcccttaaaccttcctgcgtaatctattatacaggtgaattaagtattgaccaagcacaataaaaatagatcatggagtttcatgggatcctaaatttgatcaaattaagaatcagcaaaacatcttttgtagatacccttttttgagttcctggagtttttcaagcttacgctgatgaagagctatagtatcgtctagctgtttgaaaatttcaacttgtaagggggtctggtagcccagtgaactatgaattctcttcctattgtagaaagcatgcacatattcaaaaaggacagcagcggcagtttcataattctcaaagaccggcactggataaacacattcctttttgagggaagcatgaaaagattccattggtgcattatcgtatggacaccccttacggctgtaagagtggcggatatgtagttctgttaaccgttggtttttggtgccgtaccccgcaacaaatgcggcgcttcattggcattatcttaaatgctaagtatcgagttgaaaaggatcatcaagatattggcgtcataatcccgcttgacgacgaagaactaaaacctttgatgactaaagccttaagacgctactttaacgccctaagaagcaatgaaaagcatatcaagaacgtggagaactacttatacggcaccatgcaaaacctatatttgaatttatttttttagaagtttctgttagaaaatgccttcaaagttaaagtaaagactttaactttgaaggcatttttttatctcagcaaagaaaagtgatacttattgtttattattaagaatgtgggttttaaaaacaatattatttaaagaaacgattagattcattatcaattgtgaaccatatcgtttattggggtcttaaaagaatcatcaataaaaagaggtgtcgtttctttttgcggcgtttgcagattcgcttgaacttggtcgccttggtgaacgatcggtagggtggctgcctcttgctgttcggctttgtgatcatcaaataaagcttgccaaccttgcttagttgggaccttaccggttgctttaaaattggcgtcaccaacttgggtaataatggtggtttcctcgtactcgtacggatcagcaaacatcgctaatttgaatggagttcatgatcttagtcaaatcatggttgtttctgcctaagcgatctaattcagtgaccattacaatatcaccctcacgaatataggccagcattttttgcagttctggccgattagtgttagccccacttaatttatccgtaaataatttatcaacgtcttttaaagccgctaactgtcgatctaaatgttgctccttggaacttcttgattaaaccggcctgtgagcttttctgaacgcgtttagcttgcatgaatgttattagccctgcttcgtctttaaatcgctgataggggtctaattttgcgacgaatttttgctaattagcaagaatttcagcatttagttcaaaatagggtttcggcttaagaagctgtccaagatctatgatttttgatatacttctatgtaaaaagtacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgtggatgtaagctgattcctgagacaacttttaagagagcgtatggtagattgcaaatttaatccgaatttttggacaaatttgtcagcataacctgatacggtgtttgccagtcgagtattttaagcggtcgctggttaattgggagtaacgtcgtcgttaaatcttgagcactaatgtgctcaaaacgagtcccttaatttttatcaatataaaatacattatgggctaccattcataccaattaaccagtcgctaattttgtgattacaagtgcatgcccccatcttcatgccggtttcgagtttggtgttgccgttgctttttcgtcatttcccactcagtctcctttaaaccttgcgcctgtttttgccgttcgtaatcttcatcacggtccggataattttttgagccaaatcaagaagtttgtggcgaagttaatcgctgatgttcccacacaattaaccggcaatgcagccattaagcaacaaatcaatcaccaacagcaagcacaaaagtccgacgaggtcttcttagaaacaccgcaagcgaccgttttaaataaacagaagttttacattgtaaacgcttttaagctttatcaaacgggtatgagtgatgtagatgttgcccgtaatacagggattaagcggacgacctttatcagatatcgaaagaaattcaatatacaaagatgatgtttacatgagagaatcatagcagagcggaccacttgaaacttctaactccactaaaatccgagaaatgaccgtcaaacatcctaaagtaagaggtatcaagattgtgacgacaatcttgatacctcttttactatacttaaattgaggttgaggtcgtcaacatcagtggaatatacattccgagtgtcaaactggcccaacaacacgtagtgaacagttagatttaggatgtgggtccttgagatcgaatttcatcgtttacggcatggactaccagggtatctaatcctgttcgctacccatgctttcgagcctcagcgtcagttacagaccagacagccgccttcgccactggtgttcttccatatatctacgcatttcaccgctacacatggagttccactgtcctcttctgcactcaagtctgttactaaatatcataagggaaggcattccctatttctatacaattcagaaatcttttatgcatttacacaagatattttacgctcttgaatctttatattcaacacaatttgtatatcaatcagatcgtccaccaatttgcatagacaccatatatagtgctataatgatcgcgtgcgttcttcggtactgatttgctgtaacgcttgctcccatttagccgtcatttctgggctagttagcaagggttcgagttcgaccgctttacataatgtgattccggcttcactgacgtgcaacttattcttttcagtaactaagtagccgcgtttctttaacacttccaatttcatggtatggtttggagtttagcaatgtcatagaagaaagttctccgttatttattactcaagatcaggatcaatacttaatccaaaagaaaatttatcatcgaggcagattaagtaagactgaaaaatgagtatgcagtagtttaagtgcaacaactaagttagaaaaattatatttagttttaattaatggtctgatctcagtactttactgagatcagaccatttttattcatcgaaatgcgtttagtgttttactataacacgtatttagaagcaacttgtttagatctctcggtttgtaaaattaagttaatggcagattgcaagaaaaaaactttctgaaaaaaataaaattgaacaaaatctcggtaagcaaatcattagatcagccaatttggattatgggacacttaccactccacagattaaaatgattgctaaaaaagttgccgcctttttaaatcaagctcaaaataaccgataatagttaggtggtaatgactatgtccagaaatgacagctaaatgggagcaagcgttacagcaaatcagtaccgaagaacgcactcaggataattttttgagccaaatcaaaaagttcgtggcaaagttgatcgctgatgttcccacgcaattaactggcagtgcaaccattaaacaacaaattgatcatagtgagctttcttgttggttaattgtcaataattgtttagtcacatcttcaccaaccgcatgtttaattaaggtgctgtttttccaattaaatagcatgcgccgtttatcatctaagttctccaaactgatataagttttcagttcatggcttaactctttccagcaatattactcggcaacaatttgaattaattcgaccagctttagaaaattttcgtaagcgaactaagcctcgaaaatatgacctctacgaggtcttctgtgcggtcctatatgtcttgaaaaccggttgccaatggcgtcaagtccccggtgatttcctaagtagttgcacagcttctggttctaagaaaaccggtaagccactgtcttcatcagttaagaagtcattagcatggttcaccaaatcctggttttgcttttgaatttctgctggtgagaaattggctgtggaaaagtccaacttttgagtatctatatttatcaaaaatcatagatcttggacagcttctcagacagcgaagccagtcgcttttccatcgctttgatttcgtctggcgatttaccggattgagttttggcctggccctggatccacttatgaacggttgaatagccaatgccatattctctggccagtggttcccagcagttcagtccagattccagtcgattccgttggcgccacttggtagtttagcacttctttcgtaccatctggacgaatgccaatcgcaatatgaacggcttctttttgaacggtatcccgctttaacggcaagtaagtggcatctaagaactggtttctcagtttaatgtttataacgagaagtctctgaagcggatccaccgagggttcaaaggactccaggacaccttggaagcatcatttatttaagttagatacatattatatgtacgaaggcatttcatttacacaagattcttgacgctacccactacaagcatattaccatagatgaacgggaaactatctttttaatgaggaatcatggaaactcacttcgtgagattgccagccatatcaagaaaagttactcaaccatttctcgagaattaagccgtaattctactggtaaatcgtaaaatcaaggcattaaagcgtaactgttttggttttcgaaatattgacaacttctttatccggattagtttaattcatgagtaaacaaaaagcacattcaccgaagtgaatgtgccgttcaaaatctccaccaatacgattttgagttggcatgtaaaaattccttccttttgagagacgatttattcattataccctctcttaaaagttgtctcaggaatcagcttacatccaagttaaaattgcgctggattgatcgacatgctaaaccagttacctataaaggctaaatgcggaaattttagctaatcagcaaaaatttgtcgcaaaattagacccctatcagcgatttaaagacgaaacagggctaatgacattcatgcaggctaaacatgttcagaaaggatcacaggacggtttaatcaaggtccgaacaaacgctatgttgatgggaaaaaagttgaagaacactatgccattatcatgactaaagtcgtgccaacgaaagagaagctagccagcttgcctaaattacagcaacaagtctatgaactggttttaaggacgacgcaagaagctaaattaaaagcccttaatcaaaaaattaaggacgaaaaaaataagattgaacaacggctaggtaaacaaatcatcagtcaagccaatttagattatgctaatttgtctaacgatcagattaagcttttagccgaaaatctttcttgctcctgtcgatgtcgattcttgtggcaagctcggccgcaagaactcgcactattccgcctagtaatgatgattttcgttccgaaaatctttcttgctcctgtcgatgtcgattcttgtggcaaggaaatgaagccccagtaaacggcggccgtaactataacggtcctaaggtagcgaaattccttgtcgggtaagttccgacccgcacgaaaggcgtaacgatctgggcactgtctcaacgagagactcggtgaaattatgtggtaagttcattcatggggaatgcctcctgtgatgttttctgtggttactaaatatcataagggaaggcattccctatttctatacaattcagaaatcttttatgcatttacacaagatattttacgctctcggaagtttgtcaaatggtgttgaaggatagtttctatcctttggagatctcctcgtgtgggagatcttttttgttgttttattagttgcggcgtttaatctggtgtgttgtctgaatatcgtacttgaaggcatcacattggcccgggtcgcacttgtcccaatgccttgcacatctttgagaatcgcctgggctacttcatcatcaagcgttttgccagcggtcttcatggccgtaatcagggtaccttcggtaaagggtaccggttgcgaggtgaggcccatgggaacatggaataatcttcaggaaggtttcacagtcaatgagcgtcttccagacactctcgttgatgttgctgtttgcaatgtttattttagcgttgctaacatacatcgactcctgtgagcccttctgaacgtttttagcttgcatgaatgttattagccctgtttcgtctttaaatcgctgataggggtctaattttgcgacgaattcttgctaattagcaagaatttcagcatttagttgaatcaccgtccccgccgctgtttaagctatagttgtccagcggatgttatgccacaactggtttaactttctagaccaattataagaataggccattagtgttgcacttaacttgacaattgaggtggactaactggcttgtaatttagcggttgataatgtccaatatttacttttctatactggtcgtccttggcttgttgcccttttaactgcttttggattttctcgatctgactgttcttaatcgtcgggggccctattttcttttaataccgtatttcacacggtatcgaataaaggtcgtccgtttaatacctgtatttcgggacacatcaatgtcactcatgccagctcgataaagcttaaaagcatgctggcgctcaatgattcgcttacgttcactttcggcctgatacttatagagttcaataatcaagttggtcatcagttgacgtaaatttgggtcagcaatccctgtcatggacggtgttgacggtgatcggttcagccgaacgcccatttggatattggacagccctagttcacaaaaggtttcgattttaattcgttcggaataggttatactagacaaaagatcagctctgattaatttcgagtaaggtggttttcaagccttgagcactaatgtgctcaaaataagtccccttaggataaaaatagcgtaagttccgattaaatcgttcattactgccgcgcctagttagcaagggttcgagttcgactgctttacataaagtgattccggcttcactgacgtgcaacttattcttttcagtaactaagtagccgcgtttctttaacacttccagggcgccacttggtagttcagcacttctttcgtaccatctggacgaatgccaatcgcaatatgaacggcttctttttgaacggtatcccgctttaacggcaagtaagtggcaggcgattaaatcgtagcacaaagaggacagatgtccttttttatttttctgattttcaaaacagacaaaaaaccggtattagttattcaccaataccagaaagtgtagaccggtagattgcaaatttaatccgaatttttggacaaatttgtcagcataacctgatacggtgtttgccagtcgagtattttaagcggtcgctggttaatttggagtaacgtcatccatggctaaattcctttcatgattgttttcgcaaacatcattttacagaaatttggccatgggccattctttatttaattagtgttgcacttaaagtgtaaattcaaggggtctagaatttttggtgttggaaagtatttccattccaaaagtactaggccctttttgataacaaaaaaaggcatctaagcctccctagtgctatgctttaagcgacgcctcctgtgatgttttctgtggttactaaatatcataagggaaggcattccctatttctatacaatttagaaatcttttatgcgtttacacaagatattttacgctcccgggtctagaatttttggtgttggaaagtatttccattccaaaagtactaggccctttttgataacaaaaaaagcatctaagcctccctagtgctatgctttaagcgactagtgcgatcagccactttatttaagagttcatctgcttttttgagtgagctttcttgttggttaattgtcaataattgtttagtcacatcttcaccaaccgcatgttcctagcagcacttgaactaattaatcaacgaccattaaaaatacatcatcaacagactgccattgaaagattccgggcttgttcggattaaacttgtaatttgcctggtacgtagagcgtgctcgattagttacctatagctgccagccttgtgtatggtctatcaaagagaccaggcaatcaaaaactttaagccggaaccctattttgatgccagttcttgcggtctgaacttcggccacaagaatggtcatcgcccggaacatataggattattagcgttctttgctaataatcatcctctatgtggagtaggcacatttgtttgtcgaaaattttgttcagttttcaaaggtctacttggttgcgggtgagatgaatcatctctcgcgacaactatttaaatataccacgctgtgaaattgtattttatataatttcaaccgagaacaccgcgttattttgagtttgttaactagaaaaaatcgcaaatactcaattaactttgcattacgta

SEQ ID NO: 48-49 - skipped (2 entries)
